United States Patent
Kubicek et al.

(10) Patent No.: US 9,920,384 B2
(45) Date of Patent: Mar. 20, 2018

(54) **GENES/GENETIC ELEMENTS ASSOCIATED WITH MATING IMPAIRMENT IN *TRICHODERMA REESEI* QM6A AND ITS DERIVATIVES AND PROCESS FOR THEIR IDENTIFICATION**

(71) Applicant: AB Enzymes GmbH, Darmstadt (DE)

(72) Inventors: Christian P. Kubicek, Vienna (AT); Rita Linke, Vienna (AT); Bernhard Seiboth, Vienna (AT); Thomas Haarmann, Alsbach-Hähnlein (DE); Patrick Lorenz, Lorsch (DE)

(73) Assignee: AB Enzymes GmbH, Darmstadt (DE)

( * ) Notice: Subject to any disclaimer, the term of this patent is extended or adjusted under 35 U.S.C. 154(b) by 0 days.

(21) Appl. No.: 14/758,238

(22) PCT Filed: Dec. 23, 2013

(86) PCT No.: PCT/EP2013/077910
§ 371 (c)(1),
(2) Date: Jun. 28, 2015

(87) PCT Pub. No.: WO2014/102241
PCT Pub. Date: Jul. 3, 2014

(65) Prior Publication Data
US 2015/0361510 A1   Dec. 17, 2015

Related U.S. Application Data

(60) Provisional application No. 61/746,861, filed on Dec. 28, 2012.

(30) Foreign Application Priority Data

Dec. 28, 2012 (EP) .................... 12199606

(51) Int. Cl.
| | |
|---|---|
| *C12N 1/14* | (2006.01) |
| *C12Q 1/68* | (2018.01) |
| *C07K 14/37* | (2006.01) |
| *C12N 15/80* | (2006.01) |
| *C12R 1/885* | (2006.01) |

(52) U.S. Cl.
CPC ............ *C12Q 1/6895* (2013.01); *C07K 14/37* (2013.01); *C12N 1/14* (2013.01); *C12N 15/80* (2013.01); *C12R 1/885* (2013.01); *C12Q 2600/156* (2013.01)

(58) Field of Classification Search
None
See application file for complete search history.

(56) References Cited

FOREIGN PATENT DOCUMENTS

| | | |
|---|---|---|
| WO | 2011-095374 A2 | 8/2011 |
| WO | WO-2015086701 A1 | 6/2015 |

OTHER PUBLICATIONS

Schuster, et al., Biotechnology for Biofuels, vol. 5, No. 1, (Jan. 2012).

(Continued)

*Primary Examiner* — James S Ketter
(74) *Attorney, Agent, or Firm* — Mintz Levin Cohn Ferris Glovsky and Popeo, P.C.; Peter F. Corless

(57) ABSTRACT

The invention relates to a process for identifying gene(s)/genetic element(s) associated with mating impairment in strains of *Trichoderma reesei* QM6a or strains derived thereof comprising the steps of a) providing a first strain being a *Trichoderma reesei* QM6a strain having a MAT1-2 locus or a strain derived thereof, b) sexually crossing said strain with a second strain being a mating competent strain of a *Trichoderma reesei* (*Hypocrea jecorina*) strain having a complementary locus, i.e. the MAT1-1 locus, c) repeatedly back-crossing the MAT1-1 progenies from the crossing of b) or the back-crossing thereof with the first strain of a), until a strain is obtained that is substantially identical to the first *Trichoderma reesei* QM6a strain or a strain derived thereof, but carries the MAT1-1 locus and is mating competent for crossing with *Trichoderma reesei* QM6a or any of its MAT1-2 progeny, d) selecting the progeny from step c) that is mating competent for crossing with a *Trichoderma reesei* (*Hypocrea jecorina*) having a MAT1-2 locus, and e) identifying the gene(s)/genetic element(s) associated with mating impairment by comparing the genome of the progenies selected in step d) with the genome sequences of the first strain of a) whereby said gene(s)/genetic element(s) may be fully or partially missing or existing in a mutated form or in a form having deletions or insertions in the first strain thus being a gene or a genetic element directly or indirectly associated with mating impairment in strains of *Trichoderma reesei* QM6a or a strain derived thereof as well as to a process for correcting the mating impairment of a *Trichoderma reesei* QM6a strain or a strain derived thereof having a MAT1-1 locus and that is not competent to mate with a *Trichoderma reesei* QM6a strain having a MAT1-2 locus or a strain derived thereof, wherein one or more mutated or fully or partially missing gene(s) and/or genetic element(s) identified as above is/are replaced by or complemented with the corresponding functional gene(s) and/or genetic element(s). Moreover, the invention relates to the use of a thus obtained fungal strain of the genus *Trichoderma* in industrial breeding and production of a product of interest. Moreover, the invention relates to the genes associated with mating impairment of *Trichoderma reesei* QM6a and strains derived therefrom and to genes essential for mating of *Trichoderma reesei* QM6a and strains derived therefrom.

9 Claims, 27 Drawing Sheets

(56) References Cited

OTHER PUBLICATIONS

Martinez, et al., Nature Biotechnology, vol. 25, No. 5, May 2008.
Martinez, et al., Supplementary Text, Nature Biotechnology, No. 26, No. 4, (Oct. 2008).
Oct. 19, 2011; XP-002721361-002721366.
Seibel, et al., Fungal Genetics and Biology 49 (2012) 814-824.
Seibel, et al., Eukaryotic Cell., vol. 11, No. 7, pp. 885-895 (2012).
Chen, et al., PLOS ONE, vol. 7, No. 9, (2012).
Seidl, et al., Biofuels, Future Science, vol. 1, No. 2, pp. 343-354 (2010).
Seidl, et al., PNAS, vol. 106, No. 33, pp. 13909-13914 (2009).
Chang, et al., Genetics, vol. 138, pp. 75-81 (Sep. 1994).
Druzhinina, et al., PLoS ONE, vol. 5, No. 2, e9191 (Feb. 2010).
Guangtao, et al., Journal of Bioltechnology, 139, pp. 146-151 (2009).
Kang, et al., Genetics 138, pp. 289-296 (1994).
LeCrom, et al., PNAS, vol. 106, No. 38, pp. 16151-16156 (Sep. 2009).

Figure 5A

| Vector | pFSG_complement_105832 | | |
|---|---|---|---|
| Position of elements | ID 105832 | 401 | 4017 |
| | GenR | 4018 | 6383 |
| | AmpR | 7546 | 8407 |

TCGCGCGTTTCGGTGATGACGGTGAAAACCTCTGACACATGCAGCTCCCGGAGACGGTCACAGCTTGTCTGTA
AGCGGATGCCGGGAGCAGACAAGCCCGTCAGGGCGCGTCAGCGGGTGTTGGCGGGTGTCGGGGCTGGCTTA
ACTATGCGGCATCAGAGCAGATTGTACTGAGAGTGCACCATATGCGGTGTGAAATACCGCACAGATGCGTAA
GGAGAAAATACCGCATCAGGCGCCATTCGCCATTCAGGCTGCGCAACTGTTGGGAAGGGCGATCGGTGCGGG
CCTCTTCGCTATTACGCCAGCTGGCGAAAGGGGGATGTGCTGCAAGGCGATTAAGTTGGGTAACGCCAGGGT
TTTCCCAGTCACGACGTTGTAAAACGACGGCCAGTGAATTCATGTAGAGCGGCACCAAGCAGCCTTCAGAGTT
CTCAAGCCTCATGTATAAATGCTACCTCACCAGGTGCTATGGAAGCAGATTGGGTGCAGCGAATGCCTCATCA
ATCCATCAAGATACTTCAACAGGAGCTCACCACCGAAAGCCACTGATATAAGCTGAAGGAAAGGCAGTCTAAA
CAGCGAAAACAAAAACAATGAGTTGGCAGCGTAATCTTGACGCCCAGATATCTACATCTACATTACAGATGCT
GTCGACTTGACTAGAAGTTTGGTCAAAACAGGGTAGTCGTGGAACGGAGACGAGCGTTTGCAATTGGGCGTA
TGACGTCATTGCGTGAGCCATCAGATAGATGTTGCATGGAGCGTAATGGTTGATCTTGGTTGATCGACAGATA
AGATAAGCACCCGCAAATTTTCGCGGGGCACTTGATGCGCAATATCGATACCCGATAACGATAACACTTTGAT
GTTATTGGACTCTGTACGCACTGTTTTTGCTGCCAAGATTGGTTGTTGTCTTTATTTCATACGCGTTCCGACAGA
ATTTGCATACATGCAGCGATTGGAAAGAGCCTTCAGCCTTCTTCTTCGTACCTGACCTTGTGATGATTTGCTGCG
AGTAACTTCGTATCTTGCGAGTCATAGACAAGGTGGTGAGGGTGAGGCGGGGCATCGTACCTGGTGGGGTAT
CAGATCTGCTAAATGTTTTCGTGCTATCTTGTTAGGACATCAAATTCTTCCGAGTGTCTCATCGCTGCGCTTTTTC
CACGACTTCGCCGAACTCCTGCGAAAATCACCGAGCCGTCGCTCACTTGAGCAAACGAAGCCGAGTCACACGC
TTCCAGCTCTCTCTCGACGTTCAAGATGAGCCCGAAACCCGTCATCGGCCTTTTGGGAGGCGGCCAGCTGGGC
CGGATGCTGTGCCAGGCCGCGGCTCCCCTCGATGTCGAAATCGCCATCCTCGACGCCGAGAATGCCCCGCGA
AGCAGGTCAACCACAACAGCCGCAACATCAATGGCTCGTACAAAGACGCGGAGAAGATCAAGGAGCTGGCCT
CCCACTGCAGCGTCCTCAGCGTCGAGACCGAGCACGTGGACACGACGGTGCTGGAAGAGATTGCGACGACTA
CAAAGGTGGCCGTGTGCCCGTCATGGAAGACGATTCGACTGATCCAGGACAAGTACGAGCAGAAGGCCTACC
TGGCCAGCAAGGGAATTCCCGTCGCTGAGTCGGTGGCTATTGAGGGATCTGGCGATGCCATGCTCGCCTCTCT
CAAAGCCGTGTCTGCCAAATTCGGCTATCCCTGGATGCTCAAGGCCAGGAAGGACTCTTACGACGGCCGAGG
GAACATGAAGATCTCTGGCGAAGCCGACCTCGAACATGCTGTCGCCGAGTTTGGCAAGTTTGGCTGCTATGCT
GAAAAGTTTGTCCCGTTCCAATGCGAGCTGTCTGTCCTCGTGATTCGCACGGAAGACGACGACGGCCAGACCA
AGCGCCTGCTGCCGTATCCCGCCGTCGAGACGGTACATGAAGACAACATTTGCTCACGAGTCTACCTGCCTCCT
CGGACCACTCCTGCTTCTGCCTGCGAGCAGGCACAGAAGGTCGCCAGCGACGTCGTCGACAAGCTTTGGGGA
AGAGGCATCTTCGCTGTTGAGATGTTTGTCACCCAGGACAACCAGATCCTTGTCAACGAGATTGCCCCGCGACC
GCACAACTCTGGCCATCTGTTCATTGAAGCGGTTCCATACATGTACGTATTCACCCGTTGCCCTGCTGGTTACTG
CTCTAACAAGGCTGTATATTAGGTCACAGTACAAGGCACAGCTCACCTCGATCCTCGACCAGACTCTCCCGCCC
AAAATTGAGCCGTACGTTGCTTCGAGTATCATGATCAACATTCTCGGAGGCGCCAATCCCGACTCCCATCTCCC
GCTTGTCGAGAAAGCCAAGTCCATGTACGGAGACAAGATGGCTGTTTACGTCCACCTTTATGGCAAAGAGTCC
AAGCCCAGCCGAAAGATTGGACACATCACAGTTACTGGCTTAGTCGCCAGCATAGCGGAGCTCGAAGAGTTTG

Figure 5A (Continued)

CGAAACCGCTGGTGGACATGGCCAGCGACATCAGACAGGAGAGGCTACAATCGCGCACCAAGGCATTGCGGC
CAGACCAGGCGGTTTCCAAGCCCGCTCAGGCGCCGCTGGTCCTTGTTACAATGGGCTCGGACTCAGACCTTCCT
GTGCTTAAGGCTGGCATCGACATCCTGAACCAGTTTGGCGTGCCCTGGGAAGTTGACATCACATCGGCGCATC
GCACGCCGGCCAAGATGGCTGATGTCGCCACGAAAGCCGCTGCTCGCGGCATCAAGGTCATCATCGCCGCAG
CTGGAGGAGCAGCTCATTTGCCTGGAATGGTGTCGGCCTACACGCCGCTCCCCGTCATTGGCGTTCCCGTCAA
GGCCACGCACCTCGATGGTGTCGATTCTCTCTATTCGATTGTTCAGATGCCGGTAAGTACATACAACCTTTTTG
GCTTCCTTTCCCCTTCCTTGTACGTGAGGCTGACGAGCGTATAGCGCGGTGTACCGACAGCCACGGTTGGCATC
AACAACTCGACCAATGCAGCCCTCCTCGCAATCAGATGCCTAGGTGCCTTTATTCCCGAATACCTCGAGAAAAT
GAAGGCGTATCAGCTGGACAACGAGAAGCAAGTGGAAGAGAAGGCGAACCGACTGCGAGAGATGAACGTCG
AGGCCTACCTTGCGCAAATGAAGAAATGAGGGAGTCTTAATTTGACGCTGCGAGCCAGCTGGCCCAACCTCGA
TATCCTAGGCTGACCGTGAAGGACGATCATGCACCAAAACCAGTTCCTGCGTGCATAACTTAGAATCGCATTCG
GAGGCTTTGCGGATCGAACCATCGACTCCCAGCAATTGTATGCTTTGGCCGCTGACACCACGCCTCAACATGCA
ACATTCGTTGTGGCATTATTTCGAATCACGAATATCTACAGTGTCTTATATATATCTCAACTTTGGAAAAGAATC
AACCCACTTAATGCCTCACGAGGCTTCTCATTAGATAGGGCGGTGGCAAATCTGTAAAGCAGGCGAGATCACG
CAACCAAGACATGATCCGGTGTCCTTTCCCTGTGGTTGATGAGTATCCAATCGTGAGCATATGGCAGCGAGCT
GTGCTCTCCAGGCGCCCGAGTGGAAGGCATGCCTCTACTCTTATATAGGCCAATCCAAAGTTTTTGAGCAACAA
GACTTTTGGCGTATAACACTAGCAGTTGAACGCCCCGGGGATAGGAGTCTTCGCACTGACCACTCGACAACTA
GAGTAGTCAATCGGCTGACTATCCCCCGTCCTGATCATGTGAATCTACTATCCCACTCTTCTTGGCCCTCAGGAG
TCCCTCTGAAGGGCTCTCTGGGGGACCTCAGAGACTCCATTTGTTTGTGTGACTGTCCGCGAAGCTATGGGCTA
CAAGGCAGACCATCATGCTCGCCTGCGCCGTTGTCAAAACCTCGTCCTTGCTCGAGCAGCCTGTTAATGGCCTC
TTCGCCACCGGATTGATTGTGGCAACTGGAAGGGCCTCAGATTGTGAACGAAAGCCACGCGATTGTCTAGACG
GCTTTGATTTCCTTCAGGTCATACGAGGCTTGTGCAATGGTCTCCGCATGGATCGCTGCTGTTCTCCTATCAAAC
TCGGATTTTGTCTTAGGGGATGGCGTAGGAAAGACGCTGCCGCGGTTCAGAAGCACCTCGATGCTATCAGGAT
GTGACAAAAACGACTCGAAAACCCGGATTCATCGGTGATGCTTTCGGGATCGCAAGCGTAAAGAAAGACTCTC
TTCCAAGACCTAGAAGTATAGCAAAATCAGCAGCAGACCATCAATGTATAGCGAATGCGCCCATACAAAAGCT
GAACGTCCCCGGAGAAGCACTTGTCCAGGGACGGGAAATAGGCTTCCGGAACGGGAGCCATTGGCAGCACA
GCTATATCATTCTAAGTAAACAAATGTAATGAGCAAGCGGACGGAGTGCTGAAACCTCCGTATGCCTGAAGCC
GACGAAAGCGCGTTGGATTAGAGGTCGACAGAAGATGATATTGAAGGAGCACTTTTTGGGCTTGGCTGGAGC
TAGTGGAGGTCAACAATGAATGCCTATTTTGGTTTAGTCGTCCAGGCGGTGAGCACAAAATTTGTGTCGTTTGA
CAAGATGGTTCATTTAGGCAACTGGTCAGATCAGCCCCACTTGTAGCAGTAGCGGCGGCGCTCGAAGTGTGAC
TCTTATTAGCAGACAGGAACGAGGACATTATTATCATCTGCTGCTTGGTGCACGATAACTTGGTGCGTTTGTCA
AGCAAGGTAAGTGAACGACCCGGTCATACCTTCTTAAGTTCGCCCTTCCTCCCTTTATTTCAGATTCAATCTGAC
TTACCTATTCTACCCAAGCATCGATATGATTGAACAAGATGGATTGCACGCAGGTTCTCCGGCCGCTTGGGTGG
AGAGGCTATTCGGCTATGACTGGGCACAACAGACAATCGGCTGCTCTGATGCCGCCGTGTTCCGGCTGTCAGC
GCAGGGGCGCCCGGTTCTTTTTGTCAAGACCGACCTGTCCGGTGCCCTGAATGAACTGCAGGACGAGGCAGC
GCGGCTATCGTGGCTGGCCACGACGGGCGTTCCTTGCGCAGCTGTGCTCGACGTTGTCACTGAAGCGGGAAG
GGACTGGCTGCTATTGGGCGAAGTGCCGGGGCAGGATCTCCTGTCATCTCACCTTGCTCCTGCCGAGAAAGTA
TCCATCATGGCTGATGCAATGCGGCGGCTGCATACGCTTGATCCGGCTACCTGCCCATTCGACCACCAAGCGA
AACATCGCATCGAGCGAGCACGTACTCGGATGGAAGCCGGTCTTGTCGATCAGGATGATCTGGACGAAGAGC
ATCAGGGGCTCGCGCCAGCCGAACTGTTCGCCAGGCTCAAGGCGCGCATGCCCGACGGCGAGGATCTCGTCG
TGACCCATGGCGATGCCTGCTTGCCGAATATCATGGTGGAAAATGGCCGCTTTTCTGGATTCATCGACTGTGGC
CGGCTGGGTGTGGCGGACCGCTATCAGGACATAGCGTTGGCTACCCGTGATATTGCTGAAGAGCTTGGCGGC
GAATGGGCTGACCGCTTCCTCGTGCTTTACGGTATCGCCGCTCCCGATTCGCAGCGCATCGCCTTCTATCGCCTT

Figure 5A (Continued)

```
CTTGACGAGTTCTTCTGAGGATCCACTTAACGTTACTGAAATCATCAAACAGCTTGACGAATCTGGATATAAGA
TCGTTGGTGTCGATGTCAGCTCCGGAGTTGAGACAAATGGTGTTCAGGATCTCGATAAGATACGTTCATTTGTC
CAAGCAGCAAAGAGTGCCTTCTAGTGATTTAATAGCTCCATGTCAACAAGAATAAAACGCGTTTCGGGTTTACC
TCTTCCAGATACAGCTCATCTGCAATGCATTAATGCATTGGACCTCGCAACCCTAGTACGCCCTTCAGGCTCCG
GCGAAGCAGAAGAATAGCTTAGCAGAGTCTATTTTCATTTTCGGGAGACGAGATCAAGCAGATCAACGGTCGT
CAAGAGACCTACGAGACTGAGGAATCCGCTCTTGGCTCCACGCGACTATATATTTGTCTCTAATTGTACTTTGA
CATGCTCCTCTTCTTTACTCTGATAGCTTGACTATGAAAATTCCGTCACCAGCCCCTGGGTTCGCAAAGATAATT
GCACTGTTTCTTCCTTGAACTCTCAAGCCTACAGGACACACATTCATCGTAGGTATAAACCTCGAAAATCATTCC
TACTAAGATGGGTATACAATAGTAACCATGGTTGCCTAGTGAATGCTCCGTAACACCCAATACGCCGGCCGAA
ACTTTTTTACAACTCTCCTATGAGTCGTTTACCCAGAATGCACAGGTACACTTGTTTAGAGGTAATCCAAGCTTG
GCGTAATCATGGTCATAGCTGTTTCCTGTGTGAAATTGTTATCCGCTCACAATTCCACACAACATACGAGCCGG
AAGCATAAAGTGTAAAGCCTGGGGTGCCTAATGAGTGAGCTAACTCACATTAATTGCGTTGCGCTCACTGCCC
GCTTTCCAGTCGGGAAACCTGTCGTGCCAGCTGCATTAATGAATCGGCCAACGCGCGGGGAGAGGCGGTTTG
CGTATTGGGCGCTCTTCCGCTTCCTCGCTCACTGACTCGCTGCGCTCGGTCGTTCGGCTGCGGCGAGCGGTATC
AGCTCACTCAAAGGCGGTAATACGGTTATCCACAGAATCAGGGGATAACGCAGGAAAGAACATGTGAGCAAA
AGGCCAGCAAAAGGCCAGGAACCGTAAAAAGGCCGCGTTGCTGGCGTTTTTCCATAGGCTCCGCCCCCCTGAC
GAGCATCACAAAAATCGACGCTCAAGTCAGAGGTGGCGAAACCCGACAGGACTATAAAGATACCAGGCGTTT
CCCCCTGGAAGCTCCCTCGTGCGCTCTCCTGTTCCGACCCTGCCGCTTACCGGATACCTGTCCGCCTTTCTCCCTT
CGGGAAGCGTGGCGCTTTCTCAATGCTCACGCTGTAGGTATCTCAGTTCGGTGTAGGTCGTTCGCTCCAAGCT
GGGCTGTGTGCACGAACCCCCCGTTCAGCCCGACCGCTGCGCCTTATCCGGTAACTATCGTCTTGAGTCCAACC
CGGTAAGACACGACTTATCGCCACTGGCAGCAGCCACTGGTAACAGGATTAGCAGAGCGAGGTATGTAGGCG
GTGCTACAGAGTTCTTGAAGTGGTGGCCTAACTACGGCTACACTAGAAGGACAGTATTTGGTATCTGCGCTCT
GCTGAAGCCAGTTACCTTCGGAAAAAGAGTTGGTAGCTCTTGATCCGGCAAACAAACCACCGCTGGTAGCGGT
GGTTTTTTTGTTTGCAAGCAGCAGATTACGCGCAGAAAAAAAGGATCTCAAGAAGATCCTTTGATCTTTTCTAC
GGGGTCTGACGCTCAGTGGAACGAAAACTCACGTTAAGGGATTTTGGTCATGAGATTATCAAAAAGGATCTTC
ACCTAGATCCTTTTAAATTAAAAATGAAGTTTTAAATCAATCTAAAGTATATATGAGTAAACTTGGTCTGACAGT
TACCAATGCTTAATCAGTGAGGCACCTATCTCAGCGATCTGTCTATTTCGTTCATCCATAGTTGCCTGACTCCCC
GTCGTGTAGATAACTACGATACGGGAGGGCTTACCATCTGGCCCCAGTGCTGCAATGATACCGCGAGACCCAC
GCTCACCGGCTCCAGATTTATCAGCAATAAACCAGCCAGCCGGAAGGGCCGAGCGCAGAAGTGGTCCTGCAA
CTTTATCCGCCTCCATCCAGTCTATTAATTGTTGCCGGGAAGCTAGAGTAAGTAGTTCGCCAGTTAATAGTTTGC
GCAACGTTGTTGCCATTGCTACAGGCATCGTGGTGTCACGCTCGTCGTTTGGTATGGCTTCATTCAGCTCCGGT
TCCCAACGATCAAGGCGAGTTACATGATCCCCCATGTTGTGCAAAAAAGCGGTTAGCTCCTTCGGTCCTCCGAT
CGTTGTCAGAAGTAAGTTGGCCGCAGTGTTATCACTCATGGTTATGGCAGCACTGCATAATTCTCTTACTGTCA
TGCCATCCGTAAGATGCTTTTCTGTGACTGGTGAGTACTCAACCAAGTCATTCTGAGAATAGTGTATGCGGCGA
CCGAGTTGCTCTTGCCCGGCGTCAATACGGGATAATACCGCGCCACATAGCAGAACTTTAAAAGTGCTCATCAT
TGGAAAACGTTCTTCGGGGCGAAAACTCTCAAGGATCTTACCGCTGTTGAGATCCAGTTCGATGTAACCCACTC
GTGCACCCAACTGATCTTCAGCATCTTTTACTTTCACCAGCGTTTCTGGGTGAGCAAAAACAGGAAGGCAAAAT
GCCGCAAAAAAGGGAATAAGGGCGACACGGAAATGTTGAATACTCATACTCTTCCTTTTTCAATATTATTGAAG
CATTTATCAGGGTTATTGTCTCATGAGCGGATACATATTTGAATGTATTTAGAAAAATAAACAAATAGGGGTTC
CGCGCACATTTCCCCGAAAAGTGCCACCTGACGTCTAAGAAACCATTATTATCATGACATTAACCTATAAAAAT
AGGCGTATCACGAGGCCCTTTCGTC
```

Annotation: Phosphoribosylamidoimidazole-succinocarboxamide synthase
Number of exons: 3

Position of elements

| | | |
|---|---|---|
| promoter | 1 | 887 |
| exon 1 | 888 | 1777 |
| exon 2 | 1833 | 2520 |
| exon 3 | 2587 | 2790 |
| terminator | 2791 | 3659 |

TAAAACGACGGCCAGTGAATTCATGTAGAGCGGCACCAAGCAGCCTTCAGAGTTCTCAAGCCTCATGTATAAA
TGCTACCTCACCAGGTGCTATGGAAGCAGATTGGGTGCAGCGAATGCCTCATCAATCCATCAAGATACTTCAAC
AGGAGCTCACCACCGAAAGCCACTGATATAAGCTGAAGGAAAGGCAGTCTAAACAGCGAAAACAAAAACAAT
GAGTTGGCAGCGTAATCTTGACGCCCAGATATCTACATCTACATTACAGATGCTGTCGACTTGACTAGAAGTTT
GGTCAAAACAGGGTAGTCGTGGAACGGAGACGAGCGTTTGCAATTGGGCGTATGACGTCATTGCGTGAGCCA
TCAGATAGATGTTGCATGGAGCGTAATGGTTGATCTTGGTTGATCGACAGATAAGATAAGCACCCGCAAATTT
TCGCGGGGCACTTGATGCGCAATATCGATACCCGATAACGATAACACTTTGATGTTATTGGACTCTGTACGCAC
TGTTTTTGCTGCCAAGATTGGTTGTTGTCTTTATTTCATACGCGTTCCGACAGAATTTGCATACATGCAGCGATT
GGAAAGAGCCTTCAGCCTTCTTCTTCGTACCTGACCTTGTGATGATTTGCTGCGAGTAACTTCGTATCTTGCGA
GTCATAGACAAGGTGGTGAGGGTGAGGCGGGGCATCGTACCTGGTGGGGTATCAGATCTGCTAAATGTTTTC
GTGCTATCTTGTTAGGACATCAAATTCTTCCGAGTGTCTCATCGCTGCGCTTTTTCCACGACTTCGCCGAACTCC
TGCGAAAATCACCGAGCCGTCGCTCACTTGAGCAAACGAAGCCGAGTCACACGCTTCCAGCTCTCTCTCGACGT
TCAAGATGAGCCCGAAACCCGTCATCGGCCTTTTGGGAGGCGGCCAGCTGGGCCGGATGCTGTGCCAGGCCG
CGGCTCCCCTCGATGTCGAAATCGCCATCCTCGACGCCGAGAATGCCCCGCGAAGCAGGTCAACCACAACAG
CCGCAACATCAATGGCTCGTACAAAGACGCGGAGAAGATCAAGGAGCTGGCCTCCCACTGCAGCGTCCTCAG
CGTCGAGACCGAGCACGTGGACACGACGGTGCTGGAAGAGATTGCGACGACTACAAAGGTGGCCGTGTGCC
CGTCATGGAAGACGATTCGACTGATCCAGGACAAGTACGAGCAGAAGGCCTACCTGGCCAGCAAGGGAATTC
CCGTCGCTGAGTCGGTGGCTATTGAGGGATCTGGCGATGCCATGCTCGCCTCTCTCAAAGCCGTGTCTGCCAA
ATTCGGCTATCCCTGGATGCTCAAGGCCAGGAAGGACTCTTACGACGGCCGAGGGAACATGAAGATCTCTGG
CGAAGCCGACCTCGAACATGCTGTCGCCGAGTTTGGCAAGTTTGGCTGCTATGCTGAAAAGTTTGTCCCGTTCC
AATGCGAGCTGTCTGTCCTCGTGATTCGCACGGAAGACGACGACGGCCAGACCAAGCGCCTGCTGCCGTATCC
CGCCGTCGAGACGGTACATGAAGACAACATTTGCTCACGAGTCTACCTGCCTCCTCGGACCACTCCTGCTTCTG
CCTGCGAGCAGGCACAGAAGGTCGCCAGCGACGTCGTCGACAAGCTTTGGGGAAGAGGCATCTTCGCTGTTG
AGATGTTTGTCACCCAGGACAACCAGATCCTTGTCAACGAGATTGCCCCGCGACCGCACAACTCTGGCCATCTG
TTCATTGAAGCGGTTCCATACATGTACGTATTCACCCGTTGCCCTGCTGGTTACTGCTCTAACAAGGCTGTATAT
TAGGTCACAGTACAAGGCACAGCTCACCTCGATCCTCGACCAGACTCTCCCGCCCAAAATTGAGCCGTACGTTG
CTTCGAGTATCATGATCAACATTCTCGGAGGCGCCAATCCCGACTCCCATCTCCCGCTTGTCGAGAAAGCCAAG
TCCATGTACGGAGACAAGATGGCTGTTTACGTCCACCTTTATGGCAAAGAGTCCAAGCCCAGCCGAAAGATTG

Figure 5B (Continued)

GACACATCACAGTTACTGGCTTAGTCGCCAGCATAGCGGAGCTCGAAGAGTTTGCGAAACCGCTGGTGGACAT
GGCCAGCGACATCAGACAGGAGAGGCTACAATCGCGCACCAAGGCATTGCGGCCAGACCAGGCGGTTTCCAA
GCCCGCTCAGGCGCCGCTGGTCCTTGTTACAATGGGCTCGGACTCAGACCTTCCTGTGCTTAAGGCTGGCATC
GACATCCTGAACCAGTTTGGCGTGCCCTGGGAAGTTGACATCACATCGGCGCATCGCACGCCGGCCAAGATGG
CTGATGTCGCCACGAAAGCCGCTGCTCGCGGCATCAAGGTCATCATCGCCGCAGCTGGAGGAGCAGCTCATTT
GCCTGGAATGGTGTCGGCCTACACGCCGCTCCCCGTCATTGGCGTTCCCGTCAAGGCCACGCACCTCGATGGT
GTCGATTCTCTCTATTCGATTGTTCAGATGCCGGTAAGTACATACAACCTTTTTGGCTTCCTTTCCCCTTCCTTGT
ACGTGAGGCTGACGAGCGTATAGCGCGGTGTACCGACAGCCACGGTTGGCATCAACAACTCGACCAATGCAG
CCCTCCTCGCAATCAGATGCCTAGGTGCCTTTATTCCCGAATACCTCGAGAAAATGAAGGCGTATCAGCTGGAC
AACGAGAAGCAAGTGGAAGAGAAGGCGAACCGACTGCGAGAGATGAACGTCGAGGCCTACCTTGCGCAAAT
GAAGAAATGAGGGAGTCTTAATTTGACGCTGCGAGCCAGCTGGCCCAACCTCGATATCCTAGGCTGACCGTGA
AGGACGATCATGCACCAAAACCAGTTCCTGCGTGCATAACTTAGAATCGCATTCGGAGGCTTTGCGGATCGAA
CCATCGACTCCCAGCAATTGTATGCTTTGGCCGCTGACACCACGCCTCAACATGCAACATTCGTTGTGGCATTAT
TTCGAATCACGAATATCTACAGTGTCTTATATATATCTCAACTTTGGAAAAGAATCAACCCACTTAATGCCTCAC
GAGGCTTCTCATTAGATAGGGCGGTGGCAAATCTGTAAAGCAGGCGAGATCACGCAACCAAGACATGATCCG
GTGTCCTTTCCCTGTGGTTGATGAGTATCCAATCGTGAGCATATGGCAGCGAGCTGTGCTCTCCAGGCGCCCG
AGTGGAAGGCATGCCTCTACTCTTATATAGGCCAATCCAAAGTTTTTGAGCAACAAGACTTTTGGCGTATAACA
CTAGCAGTTGAACGCCCCGGGGATAGGAGTCTTCGCACTGACCACTCGACAACTAGAGTAGTCAATCGGCTGA
CTATCCCCCGTCCTGATCATGTGAATCTACTATCCCACTCTTCTTGGCCCTCAGGAGTCCCTCTGAAGGGCTCTC
TGGGGGACCTCAGAGACTCCATTTGTTTGTGTGACTGTCCGCGAAGCTATGGGCTACAAGGCAGACCATCATG
CTCGCCTGCGCCGTTGTCAAAACCTCGTCCTTGCTCGAGCAGCCTGTTAATGGCCTCTTCGCCACCGGATTGATT
GTGGCAACTGGAAGGGCCTCAGATTGTGAACGAAAGCCACGCGATTGTCTAGACGGCTTTGATTTCCT

Figure 6A

| Vector | pFSG_complement_67350 | | |
|---|---|---|---|
| Position of elements | ID 67350 | 401 | 7063 |
| | GenR | 7064 | 9429 |
| | AmpR | 10592 | 11453 |

```
TCGCGCGTTTCGGTGATGACGGTGAAAACCTCTGACACATGCAGCTCCCGGAGACGGTCACAGCTTGTCTGTA
AGCGGATGCCGGGAGCAGACAAGCCCGTCAGGGCGCGTCAGCGGGTGTTGGCGGGTGTCGGGGCTGGCTTA
ACTATGCGGCATCAGAGCAGATTGTACTGAGAGTGCACCATATGCGGTGTGAAATACCGCACAGATGCGTAA
GGAGAAAATACCGCATCAGGCGCCATTCGCCATTCAGGCTGCGCAACTGTTGGGAAGGGCGATCGGTGCGGG
CCTCTTCGCTATTACGCCAGCTGGCGAAAGGGGGATGTGCTGCAAGGCGATTAAGTTGGGTAACGCCAGGGT
TTTCCCAGTCACGACGTTGTAAAACGACGGCCAGTGAATTCAATAAAGACGGCCTGGAAACGGAGCGGCTTG
AGCAGCTCTCTTTGTTCCCAACTGCGTGACCAACCAGCCCGCATCCCGCATCCCACATCCAGCCCAAACCTCTCC
TGCATCCGCCTGCATCACCCATTACGCCTGATCCTCCAAACAGGAGCATCCCCTAGGCGGTACGAACAAGCGCC
GAGCTAATCAGATCAGCCCCTCCCCTAACGCTCTGCAGCACATCACAGAAACCCGTTGTCCAAGCTTGCCCTTA
CATGCAAAACCGTGACGCTGCCCTCTTCCGTTAGGCTGCTCAGCCTTCTTCCCTTTTTCAACCTCATCTCGTTGCT
GTAGCCTGTCACGACCAAGTTCCTGCATCTCTGGGAACATCCTCCACGGCATATCACAGCTTACATCCCGCCCG
GCAATCGACCCTCTTCGACGCTCCCGCCTCCACGATACCAACAACCTCCACCATCCCCGTCGACGGCCCGAACG
GAACCGGTCACCTGGTGGATTGCAGCGCTGAGCCTTGTGTCCGGGAGTGGGCAGTAGCAGGGTTTCATGTCA
TGATCGATACCTGAAGAGCGCCGCAGCTTGCCGCCACCTTGTGGACTCATCCCTCGACAAGCGTTCTCGGAAG
AGGTCTGACCTTGGCTTGGCGACAGGATTGTGACACCAAAGCCGGTACTGTCTCACGAGCTTGGAGGGGCGG
AACAGTGCCCTCTGAGCTGGCTCGAGGAGGAGGCCGTCTAGACCGGCCAATATAAGCTTGGACCCGACAGAG
TCGGCCGTCGAAACACATCGAGAGTAAACCGCAGACATGTCTTCCACATCGCATATCCAGACTGTCTCCAATCG
GTCCGGCAAGTCGTCGACCGCTCGGGGCCGCCCAGCGCCGCCCGAGTTCGCACAGATGCCGTCCGCCGCGGA
CCTCAAATACTTCATCCCGTCTGCTGCCACGGCGTCCATCTTCCTCTATGCGCAGGGACCAACGATAGTCTGTTG
CCATCACGACACGCTCACCATCGACCGGAGGTTCTCACGCCATGTCGACGATGTCCAGCTGCTTGCCGTGGATA
ACCAGAGCGACATGGGCGCTGGCCGGTTCGTCGTGAGCTATGACGCTGGCCAGACTGCCATTGTGTGGGATC
TAATGACGGGCGATGAGATTTCGCGTTTCGTTTCGTACGAGACGCTCACAGTCGCCGCTTGGATGCGGAATGG
AAACGTTGCTTTCGGTGAGCGGAACCAGAGATCGCCCTCCCCCTCTCCCCTTAAGCTGGTGACATGAGGTGGC
TAACGGATTGGGCTTCCAGGCAACACACAGGGAAACATCATCATGTTTGAACCTACTACATCCGAGCATATCTC
GGCTCGGACGCTAGACCAGATTGCAGTGACAGCATTAGCCCCTTCGTCTGACTGCCGGACCTTTGCGATCGGG
TAAGTTGGTGTTCGACCATGAATCGAGAAGTCTGTCGCGAATGTGCCACGGCGTACTGATTCCATCCGATGTA
GCTACCAGAACGGATCTCTCTTGGTCGCAACTCTGCAGCCTCGGTTCACCATCTTACACAACCTGACGACCTCG
AGAGGGCCATCGCCCATTGTCACCCTCGCCTGGCACGCGTCCTCCTCGAGGCAGAAATCAGACATGCTGGCCG
TACAGACGCACGATGGCGACCTGCGGGTCTGGAGTGTGGCCAAGTCGTACAGCGCCGAAGATCCCGCCAAGG
TCGTCAGGGTGCTCCGCAGGAACGAGAACTTCCTGGCTGGGCCCAATTGGATGGGGTGGTCCAAGAACGGCC
GCATCATCCAATACTCGGACTCGTAAGTCCCCTATCAACTGGACACAGCCTAAGCGCGCGGCCTCCCGCTTCTG
CTGGTTTGGTTTTTTGTTGTGCTGACCTCGTTGTGCAGGGAAACGTTTTCGTGGGACGTGAGAACCAAACATGT
CACAAAGGACTCCATCCCGACCCTTGAGCATGTTAAAGGCCTGGCCGTCTATGGCCCAGGAGCCAGTCTCTTCA
```

Figure 6A (Continued)

```
CCCTTGGACCGAACAACACCGTGCAGCAGTTTGACCTCAACTCCCCAGCCATCATGGTGGCAAACGTGCAGCA
CCCCGCGGGCGTCCTTCCGCCATCTCCACCCACCTCCGAGGAGACAGGGGGCAGGTCGGTGCACTCTGCCACG
ACCATTCATACCTCGGAATCCGAGTCGAGCTCTGTCCCCCTCGAGATGGGCATCTCTGAAAGCGATGACGACC
ACCTATCCCCTTTCCAGCGGCTAGCAAAGCGCAATGCCCCCGAAGCCAGGAACGAGGTGTACGATACAGGCA
GCGCGGCCTCTAGCCAGAGCGGCGTGTCATCCTTGTCAAAGTCTTCGGCCAGCTCTCGTACGCCTGGCAGGCA
GGCCAGCTCGCTCAGGTCGCGGGGAATGACGGAGGGGACATACATCTCCGCTGGTTCATCCATGAAAACTTC
GACAGTTGGCCAGCGCGAGGCGGACAACTACTCCATGGGATACACACTCCCTAGCACCAGCGGTCCATCATTG
GCGTCGTCCCGGTCCAGGCATCGGCCCTCTCGTCTCAGACACGAAGTACCGAGGAGTCCTGACGAGGCCAACG
TGCAGGACCTGTTCAAATACACTCGCTCGCGGCTTAGCGACCTCCCGTACAAGCACCCGATGCCAACGCAACG
ATCTCATCCTACCAATGACGATTTGCGCCGACAGATGCTCAGCACTATCTTTGGCTGGAACAAGGAAGTAGAA
GACCTCATTCGAGACGAGATGAGTCGCTATCCCGCAGGGTCGGCGAACCGAATCTTGCTAGCCAAGTGGCTG
GGCGACATTGACGCAGACATCATGGCCGCGGGTTCCCAGAACATGACTTCCCAAGACTGGATGCTGCTGGCAC
TGAGCGGCATTGGCGGCCAGGCATCCCAGCACAAGCTCGGCCGAGTCTATGTCCAACGCTTGCTAGAGAATG
GCGATGTCCATGTTGCGGTGACGATTATGCTTGGGATGGGCGACTATAACGATGCCATTGAGGTCTACATCTC
GCACAAGCGGTATATGGAGGCCCTCATTCTCACCTGCGTGGCTTTTCCCAGCGTCTGGGAGCGTCAAGCTGCC
ATTGTGCGCAAATGGGGTGAGTGGGCGGTCAAGCATGGCCAGCAGCAACTGGCAATTCGTTGCTTTGCCTGTA
CCGACCAGGAGTCCTCGGAGCCTTGGACCTCTCCATCGGCTGCCCAGCTAAACTTCCAAAACATCACCCCGAGC
ATCCCCGAGGTGCTGAGCCCTCCGCTGTCGCCCCGGGCATTCAGAGAGGCCCCCAGCGCAGCGTCGCCAAG
GCATCGGCACTGAAGCTGATTACGTCCTTTGGAGATCCCACCCAAAAGGCCAAGTTCTACTCGCAGGCTGACG
GCGGCCAGACACCAATTGCAGCTGGAGTGACGCCCATTGCCGAGTCGGCCATCTCTCCGGGAGGCGCCTATG
ATCCCGCAACTGCGTTCCTCCGGCCGTCGGGCAATAGCAGGTTCAACACGCCAACATCAGCCCGCCCTATCGGT
CAGGGCTTCAGCCGCGGACGGCTGCCCTCCATCGGAGAAGCCAACAAGCCCCTGGATAACATTGCAAGCATTG
TGGACGCACCCCAGAAACGGCCGAGCCATTCTCGCAAGTCGTCCGCCCCTCAAGATAACATGGCAACCGGGCT
CGCCATGCAGCGCGCTGCTACGGCCAGCCCAATGATGATGAGGGACCAGTACCAGCGCGCCGTGCAAGGGTA
CGGAGGAGAGCGACCGCCGTCTCCCGACCATAACATCATGAGCAGACTGCAAGAGGTCCATTCGGCACAGCG
AAACGGCTCCCGTGACCGGATTCCTGCTCACCTTAGCCTGCAGCTGCAGACGATGCAGCCGCCATCGATGGAG
GCAATGTCTCCTGAGCAATCCGGCGCCTCATCCGCTCGCTTCCACTGGCCGTCTCGTCGCCGCGGTACTGGTCC
TAGTTCCGCATCTGTGGCCGGTTCCATGACATCCACCTCCAGCGCTGGCCGGAGTCACAAATCGAACGCTCGAC
AAAGGGATGATTACATCCATAGCCTGGAAGCGGCTCAGCACTATTCCAGGAGAGCTGGAAGCCGGACCGGAA
GCAAGGAACGGACACGAGACGCGTCCACCGGCCGCCACGCCAGCCGAGAGCGACGAACCAAGTCGCGCGAC
CCTTCGGAAGAGCGCGGCAGGGCTTCAGCCAGATCCTGGACAAGGCCAAAGCGATCACCCACATCCCCAGTTC
CAATGTCCCCCGAAGACTTGGCCATGCTGAGCAACCGGACATTCGACAACTCCGTGGAACCCCTCACGATTCG
AAAGGCGAGCGTGGCGAAAGGCAAGGCCAGCGGGCGGACATCCAGCCGCGGAAGGGGTGGATCAGTACCG
CGGTCACCGCCGTCCCCGGTGCCGCTGTCGGCAACAGCCCTGCATTATCAGGGATCGGAGGACGAGGAGGAC
TTTAGAGCAGCCATGCGGGCGCAGGAAGAGTTCAGGGCCAAGCACAGCCGCAGCGTCGGCCACAACGTCAAT
TCTCCCGCCGTAAGCCGGCGTGAGCATTCGGAAAGCCGACGAAAGGAAGCGACTGAGACTCGAGAGGCTGCA
CCCGTGGTCTTGAGCCAGACAGTATATGGACGAGCCGCTTCCACCGAGCACGCCGGCGATCTGAAGAAGATG
AAGGACGAGAGACAGCGGAAGAAGGAACAGGCTGCGCGAGAGCTAGAAGAGCGTAGGAAGTCTCTGGCCA
AGCGACAGCTCGGTCCCCAGATTCCCCATCCAAGCCAGATCTCTCCCGGGAGACCGCCGGTTCTGGTAGAGGC
CGACGATGAAAAGCTGCCGGATGATCTGCCGCCGCGCTCTGCAACAGAACCCCCGAGGACGGCGGAGCCGCC
GAGGAGCATGTATGCTCAAAACAGGCCGCAGATTGGCCTGCCTGCCACTCCCAAGGCGATGAGGCTCATTATC
CGGTCTGACGAGAATCAGTACGAGGACCTCCCTGCTCCGCCGGTGCCGGCGACGTTTTCTCAAAAGTATTCGC
CGCAGAACTCACCCCAGTACTCTCCGAAATACACGTTGGGCAGTAGTGTTTATGGAGAGGAGCAGAAGCAGC
```

Figure 6A (Continued)

AGCAGCAGCAGCAGCAACAGCAGGGACAGCAGCAGCAGCAACAACGACAGCAACAACAACAGCAGCAGCAG
CAACAGCAACAGCAGCAGCAGCAACAACAACAACTCTTTCATCAGAAAGAGGAGGAGCCGCCGTTGACACTG
CTGCCATCGACTGTCTATCAGCTGCCGTCCACTGTCTACCAACCGCCGTCTCGCCCCATGATTCCGCGAAGCAT
GTCGGCACCGATCCCTGATGAGCCACCTCACGCAATTCGATACGGGAGAAAGTCGAGTGCTAACGAGGGCAG
AGGCCTCGACGATATTGTAGAGACGGAGTGGCGTCGACAAGTGAACAACCTGGTGCCGCCTCCACCACCACCT
CCCCCTTCGGCGCCCCTGACTTTCCTCAAGGAGCTGCAGCATCTAGCCGTGCCGCCCCCTCCTCCGCCAGCACC
GCTGCCACACGTGCGACGCCAGCCGCCCGTGGCTGGAACACTGGCCTCGGGCATGATCGAAATTGTCATGGA
CGATGACGAGGCAGAAGAGCCCATGTCGGCTGCTCCCAACGACGGCATGGTGCCGGTGCTCGCCCAGCCCGA
ACCCCCTGTCAAGGGCCACAACCGCGGTCGCAGCCTCGGGGAGGGCAGCCTTTCCGGGCGTAGGACCAAGGC
GACGGAGCGCCTCCGCTCGGGCAGCCGCAGCCGCAAAGGATCCATCGGCGTCATGTCGCCCCCTCTCGAGAT
GTACGGCGGTGAGGGCAATGCCAACTCGCTGAACCAGCTCAGGTCGCCCGTGGTGGGCAATCCTCCGCCTGT
GCTGTATGACCGGGACGCCATTCGATCGCCCATTGAGGGGCATGGCCGCAAGATGTCGATGGGGCTGCACGA
GAACGGCATGTTTTAGGCTTGGGTGGGCGACTTGTTGTGTCGCACAAGGAGTTGGGGCCTATTCGGTATTCGC
TGTCAGGCTGTTCTTCGATGCCTGTATACGACGCCTGCATACGATGCGTTTGTCGCCATGACTTTGCTTGCTTTC
ATTGGCTCTGTTCTTTTCCGATCGAGGAGGTTTCTTCCCCCCCCGTGCCTGGCATCTGTGAGCATGGGACGATA
TCTTGTGTGTCCCTTTGGGGCAATATTTCTTTTCAATTCTGATAGTTGGCATGGCCATTCCTTTGTCTTCTCTTCG
TTCGGTCTTTCAGTTCTAAAGCCCTCCCCCCTTCCTTTCCACTTGAGGAAAGAAGAAGCTGTCTTACTTCTTATCC
AAGTGTGTTTTAGTGAGCATGTGCAAAACTGGGTGCTGGGATGCTTTCTCTTCATTTGCTTTGGCAACGTCATT
ATGTCCAGGGGATGGTTTTTTCATGGAATGGCGGCTTGCAAATACCATGCAAGCTATGTATATCCCGGCTTGAA
GACTCTTTTCTCGCTTTCCTTCACTGCATCTTTTTTTTTCTCTCTCTCTTCGATTCTTTATGACTGACGACGGGCAC
CTCTTTTTCTTTTTCTTTTTCTGGGCGGAGGTATAAGAGAAGCAAGTAGGTGGTATGCGGAATCTAGACGGCTT
TGATTTCCTTCAGGTCATACGAGGCTTGTGCAATGGTCTCCGCATGGATCGCTGCTGTTCTCCTATCAAACTCG
GATTTTGTCTTAGGGGATGGCGTAGGAAAGACGCTGCCGCGGTTCAGAAGCACCTCGATGCTATCAGGATGT
GACAAAAACGACTCGAAAACCCGGATTCATCGGTGATGCTTTCGGGATCGCAAGCGTAAAGAAAGACTCTCTT
CCAAGACCTAGAAGTATAGCAAAATCAGCAGCAGACCATCAATGTATAGCGAATGCGCCCATACAAAAGCTGA
ACGTCCCCGGAGAAGCACTTGTCCAGGGACGGGAAATAGGCTTCCGGAACGGGAGCCATTGGCAGCACAGCT
ATATCATTCTAAGTAAACAAATGTAATGAGCAAGCGGACGGAGTGCTGAAACCTCCGTATGCCTGAAGCCGAC
GAAAGCGCGTTGGATTAGAGGTCGACAGAAGATGATATTGAAGGAGCACTTTTTGGGCTTGGCTGGAGCTAG
TGGAGGTCAACAATGAATGCCTATTTTGGTTTAGTCGTCCAGGCGGTGAGCACAAAATTTGTGTCGTTTGACAA
GATGGTTCATTTAGGCAACTGGTCAGATCAGCCCCACTTGTAGCAGTAGCGGCGGCGCTCGAAGTGTGACTCT
TATTAGCAGACAGGAACGAGGACATTATTATCATCTGCTGCTTGGTGCACGATAACTTGGTGCGTTTGTCAAGC
AAGGTAAGTGAACGACCCGGTCATACCTTCTTAAGTTCGCCCTTCCTCCCTTTATTTCAGATTCAATCTGACTTA
CCTATTCTACCCAAGCATCGATATGATTGAACAAGATGGATTGCACGCAGGTTCTCCGGCCGCTTGGGTGGAG
AGGCTATTCGGCTATGACTGGGCACAACAGACAATCGGCTGCTCTGATGCCGCCGTGTTCCGGCTGTCAGCGC
AGGGGCGCCCGGTTCTTTTTGTCAAGACCGACCTGTCCGGTGCCCTGAATGAACTGCAGGACGAGGCAGCGC
GGCTATCGTGGCTGGCCACGACGGGCGTTCCTTGCGCAGCTGTGCTCGACGTTGTCACTGAAGCGGGAAGGG
ACTGGCTGCTATTGGGCGAAGTGCCGGGGCAGGATCTCCTGTCATCTCACCTTGCTCCTGCCGAGAAAGTATC
CATCATGGCTGATGCAATGCGGCGGCTGCATACGCTTGATCCGGCTACCTGCCCATTCGACCACCAAGCGAAA
CATCGCATCGAGCGAGCACGTACTCGGATGGAAGCCGGTCTTGTCGATCAGGATGATCTGGACGAAGAGCAT
CAGGGGCTCGCGCCAGCCGAACTGTTCGCCAGGCTCAAGGCGCGCATGCCCGACGGCGAGGATCTCGTCGTG
ACCCATGGCGATGCCTGCTTGCCGAATATCATGGTGGAAAATGGCCGCTTTTCTGGATTCATCGACTGTGGCCG
GCTGGGTGTGGCGGACCGCTATCAGGACATAGCGTTGGCTACCCGTGATATTGCTGAAGAGCTTGGCGGCGA
ATGGGCTGACCGCTTCCTCGTGCTTTACGGTATCGCCGCTCCCGATTCGCAGCGCATCGCCTTCTATCGCCTTCT

Figure 6A (Continued)

```
TGACGAGTTCTTCTGAGGATCCACTTAACGTTACTGAAATCATCAAACAGCTTGACGAATCTGGATATAAGATC
GTTGGTGTCGATGTCAGCTCCGGAGTTGAGACAAATGGTGTTCAGGATCTCGATAAGATACGTTCATTTGTCCA
AGCAGCAAAGAGTGCCTTCTAGTGATTTAATAGCTCCATGTCAACAAGAATAAAACGCGTTTCGGGTTTACCTC
TTCCAGATACAGCTCATCTGCAATGCATTAATGCATTGGACCTCGCAACCCTAGTACGCCCTTCAGGCTCCGGC
GAAGCAGAAGAATAGCTTAGCAGAGTCTATTTTCATTTTCGGGAGACGAGATCAAGCAGATCAACGGTCGTCA
AGAGACCTACGAGACTGAGGAATCCGCTCTTGGCTCCACGCGACTATATATTTGTCTCTAATTGTACTTTGACA
TGCTCCTCTTCTTTACTCTGATAGCTTGACTATGAAAATTCCGTCACCAGCCCTGGGTTCGCAAAGATAATTGC
ACTGTTTCTTCCTTGAACTCTCAAGCCTACAGGACACACATTCATCGTAGGTATAAACCTCGAAAATCATTCCTA
CTAAGATGGGTATACAATAGTAACCATGGTTGCCTAGTGAATGCTCCGTAACACCCAATACGCCGGCCGAAAC
TTTTTTACAACTCTCCTATGAGTCGTTTACCCAGAATGCACAGGTACACTTGTTTAGAGGTAATCCAAGCTTGGC
GTAATCATGGTCATAGCTGTTTCCTGTGTGAAATTGTTATCCGCTCACAATTCCACACAACATACGAGCCGGAA
GCATAAAGTGTAAAGCCTGGGGTGCCTAATGAGTGAGCTAACTCACATTAATTGCGTTGCGCTCACTGCCCGC
TTTCCAGTCGGGAAACCTGTCGTGCCAGCTGCATTAATGAATCGGCCAACGCGCGGGGAGAGGCGGTTTGCG
TATTGGGCGCTCTTCCGCTTCCTCGCTCACTGACTCGCTGCGCTCGGTCGTTCGGCTGCGGCGAGCGGTATCAG
CTCACTCAAAGGCGGTAATACGGTTATCCACAGAATCAGGGGATAACGCAGGAAAGAACATGTGAGCAAAAG
GCCAGCAAAAGGCCAGGAACCGTAAAAAGGCCGCGTTGCTGGCGTTTTTCCATAGGCTCCGCCCCCCTGACGA
GCATCACAAAAATCGACGCTCAAGTCAGAGGTGGCGAAACCCGACAGGACTATAAAGATACCAGGCGTTTCCC
CCTGGAAGCTCCCTCGTGCGCTCTCCTGTTCCGACCCTGCCGCTTACCGGATACCTGTCCGCCTTTCTCCCTTCG
GGAAGCGTGGCGCTTTCTCAATGCTCACGCTGTAGGTATCTCAGTTCGGTGTAGGTCGTTCGCTCCAAGCTGG
GCTGTGTGCACGAACCCCCCGTTCAGCCCGACCGCTGCGCCTTATCCGGTAACTATCGTCTTGAGTCCAACCCG
GTAAGACACGACTTATCGCCACTGGCAGCAGCCACTGGTAACAGGATTAGCAGAGCGAGGTATGTAGGCGGT
GCTACAGAGTTCTTGAAGTGGTGGCCTAACTACGGCTACACTAGAAGGACAGTATTTGGTATCTGCGCTCTGCT
GAAGCCAGTTACCTTCGGAAAAAGAGTTGGTAGCTCTTGATCCGGCAAACAAACCACCGCTGGTAGCGGTGGT
TTTTTTGTTTGCAAGCAGCAGATTACGCGCAGAAAAAAAGGATCTCAAGAAGATCCTTTGATCTTTTCTACGGG
GTCTGACGCTCAGTGGAACGAAAACTCACGTTAAGGGATTTTGGTCATGAGATTATCAAAAAGGATCTTCACC
TAGATCCTTTTAAATTAAAAATGAAGTTTTAAATCAATCTAAAGTATATATGAGTAAACTTGGTCTGACAGTTAC
CAATGCTTAATCAGTGAGGCACCTATCTCAGCGATCTGTCTATTTCGTTCATCCATAGTTGCCTGACTCCCCGTC
GTGTAGATAACTACGATACGGGAGGGCTTACCATCTGGCCCCAGTGCTGCAATGATACCGCGAGACCCACGCT
CACCGGCTCCAGATTTATCAGCAATAAACCAGCCAGCCGGAAGGGCCGAGCGCAGAAGTGGTCCTGCAACTTT
ATCCGCCTCCATCCAGTCTATTAATTGTTGCCGGGAAGCTAGAGTAAGTAGTTCGCCAGTTAATAGTTTGCGCA
ACGTTGTTGCCATTGCTACAGGCATCGTGGTGTCACGCTCGTCGTTTGGTATGGCTTCATTCAGCTCCGGTTCCC
AACGATCAAGGCGAGTTACATGATCCCCCATGTTGTGCAAAAAAGCGGTTAGCTCCTTCGGTCCTCCGATCGTT
GTCAGAAGTAAGTTGGCCGCAGTGTTATCACTCATGGTTATGGCAGCACTGCATAATTCTCTTACTGTCATGCC
ATCCGTAAGATGCTTTTCTGTGACTGGTGAGTACTCAACCAAGTCATTCTGAGAATAGTGTATGCGGCGACCGA
GTTGCTCTTGCCCGGCGTCAATACGGGATAATACCGCGCCACATAGCAGAACTTTAAAAGTGCTCATCATTGGA
AAACGTTCTTCGGGGCGAAAACTCTCAAGGATCTTACCGCTGTTGAGATCCAGTTCGATGTAACCCACTCGTGC
ACCCAACTGATCTTCAGCATCTTTTACTTTCACCAGCGTTTCTGGGTGAGCAAAAACAGGAAGGCAAAATGCCG
CAAAAAAGGGAATAAGGGCGACACGGAAATGTTGAATACTCATACTCTTCCTTTTTCAATATTATTGAAGCATT
TATCAGGGTTATTGTCTCATGAGCGGATACATATTTGAATGTATTTAGAAAAATAAACAAATAGGGGTTCCGCG
CACATTTCCCCGAAAAGTGCCACCTGACGTCTAAGAAACCATTATTATCATGACATTAACCTATAAAAATAGGC
GTATCACGAGGCCCTTTCGTC
```

Annotation: Transcription initiation factor TFIID, subunit BDF1 and related bromodomain proteins Number of exons: 6

Position of elements:

| | | |
|---|---|---|
| promoter | 1 | 918 |
| exon 1 | 919 | 1002 |
| exon 2 | 1138 | 1243 |
| exon 3 | 1322 | 1448 |
| exon 4 | 1599 | 1835 |
| exon 5 | 1926 | 5130 |
| exon 6 | 5281 | 6039 |
| terminator | 6040 | 6705 |

TAAAACGACGGCCAGTGAATTCAATAAAGACGGCCTGGAAACGGAGCGGCTTGAGCAGCTCTCTTTGTTCCCA
ACTGCGTGACCAACCAGCCCGCATCCCGCATCCCACATCCAGCCCAAACCTCTCCTGCATCCGCCTGCATCACCC
ATTACGCCTGATCCTCCAAACAGGAGCATCCCCTAGGCGGTACGAACAAGCGCCGAGCTAATCAGATCAGCCC
CTCCCCTAACGCTCTGCAGCACATCACAGAAACCCGTTGTCCAAGCTTGCCCTTACATGCAAAACCGTGACGCT
GCCCTCTTCCGTTAGGCTGCTCAGCCTTCTTCCCTTTTTCAACCTCATCTCGTTGCTGTAGCCTGTCACGACCAAG
TTCCTGCATCTCTGGGAACATCCTCCACGGCATATCACAGCTTACATCCCGCCCGGCAATCGACCCTCTTCGACG
CTCCCGCCTCCACGATACCAACAACCTCCACCATCCCCGTCGACGGCCCGAACGGAACCGGTCACCTGGTGGAT
TGCAGCGCTGAGCCTTGTGTCCGGGAGTGGGCAGTAGCAGGGTTTCATGTCATGATCGATACCTGAAGAGCG
CCGCAGCTTGCCGCCACCTTGTGGACTCATCCCTCGACAAGCGTTCTCGGAAGAGGTCTGACCTTGGCTTGGCG
ACAGGATTGTGACACCAAAGCCGGTACTGTCTCACGAGCTTGGAGGGGCGGAACAGTGCCCTCTGAGCTGGC
TCGAGGAGGAGGCCGTCTAGACCGGCCAATATAAGCTTGGACCCGACAGAGTCGGCCGTCGAAACACATCGA
GAGTAAACCGCAGACATGTCTTCCACATCGCATATCCAGACTGTCTCCAATCGGTCCGGCAAGTCGTCGACCGC
TCGGGGCCGCCCAGCGCCGCCCGAGTTCGCACAGATGCCGTCCGCCGCGGACCTCAAATACTTCATCCCGTCT
GCTGCCACGGCGTCCATCTTCCTCTATGCGCAGGGACCAACGATAGTCTGTTGCCATCACGACACGCTCACCAT
CGACCGGAGGTTCTCACGCCATGTCGACGATGTCCAGCTGCTTGCCGTGGATAACCAGAGCGACATGGGCGCT
GGCCGGTTCGTCGTGAGCTATGACGCTGGCCAGACTGCCATTGTGTGGGATCTAATGACGGGCGATGAGATTT
CGCGTTTCGTTTCGTACGAGACGCTCACAGTCGCCGCTTGGATGCGGAATGGAAACGTTGCTTTCGGTGAGCG
GAACCAGAGATCGCCCTCCCCCTCTCCCCTTAAGCTGGTGACATGAGGTGGCTAACGGATTGGGCTTCCAGGC
AACACACAGGGAAACATCATCATGTTTGAACCTACTACATCCGAGCATATCTCGGCTCGGACGCTAGACCAGAT
TGCAGTGACAGCATTAGCCCCTTCGTCTGACTGCCGGACCTTTGCGATCGGGTAAGTTGGTGTTCGACCATGAA
TCGAGAAGTCTGTCGCGAATGTGCCACGGCGTACTGATTCCATCCGATGTAGCTACCAGAACGGATCTCTCTTG
GTCGCAACTCTGCAGCCTCGGTTCACCATCTTACACAACCTGACGACCTCGAGAGGGCCATCGCCCATTGTCAC
CCTCGCCTGGCACGCGTCCTCCTCGAGGCAGAAATCAGACATGCTGGCCGTACAGACGCACGATGGCGACCTG
CGGGTCTGGAGTGTGGCCAAGTCGTACAGCGCCGAAGATCCCGCCAAGGTCGTCAGGGTGCTCCGCAGGAAC
GAGAACTTCCTGGCTGGGCCCAATTGGATGGGGTGGTCCAAGAACGGCCGCATCATCCAATACTCGGACTCGT

Figure 6B (Continued)

```
AAGTCCCCTATCAACTGGACACAGCCTAAGCGCGCGGCCTCCCGCTTCTGCTGGTTTGGTTTTTTGTTGTGCTG
ACCTCGTTGTGCAGGGAAACGTTTTCGTGGGACGTGAGAACCAAACATGTCACAAAGGACTCCATCCCGACCC
TTGAGCATGTTAAAGGCCTGGCCGTCTATGGCCCAGGAGCCAGTCTCTTCACCCTTGGACCGAACAACACCGT
GCAGCAGTTTGACCTCAACTCCCCAGCCATCATGGTGGCAAACGTGCAGCACCCCGCGGGCGTCCTTCCGCCA
TCTCCACCCACCTCCGAGGAGACAGGGGGCAGGTCGGTGCACTCTGCCACGACCATTCATACCTCGGAATCCG
AGTCGAGCTCTGTCCCCCTCGAGATGGGCATCTCTGAAAGCGATGACGACCACCTATCCCCTTTCCAGCGGCTA
GCAAAGCGCAATGCCCCCGAAGCCAGGAACGAGGTGTACGATACAGGCAGCGCGGCCTCTAGCCAGAGCGG
CGTGTCATCCTTGTCAAAGTCTTCGGCCAGCTCTCGTACGCCTGGCAGGCAGGCCAGCTCGCTCAGGTCGCGG
GGAATGACGGAGGGGACATACATCTCCGCTGGTTCATCCATGAAAACTTCGACAGTTGGCCAGCGCGAGGCG
GACAACTACTCCATGGGATACACACTCCCTAGCACCAGCGGTCCATCATTGGCGTCGTCCCGGTCCAGGCATCG
GCCCTCTCGTCTCAGACACGAAGTACCGAGGAGTCCTGACGAGGCCAACGTGCAGGACCTGTTCAAATACACT
CGCTCGCGGCTTAGCGACCTCCCGTACAAGCACCCGATGCCAACGCAACGATCTCATCCTACCAATGACGATTT
GCGCCGACAGATGCTCAGCACTATCTTTGGCTGGAACAAGGAAGTAGAAGACCTCATTCGAGACGAGATGAG
TCGCTATCCCGCAGGGTCGGCGAACCGAATCTTGCTAGCCAAGTGGCTGGGCGACATTGACGCAGACATCATG
GCCGCGGGTTCCCAGAACATGACTTCCCAAGACTGGATGCTGCTGGCACTGAGCGGCATTGGCGGCCAGGCA
TCCCAGCACAAGCTCGGCCGAGTCTATGTCCAACGCTTGCTAGAGAATGGCGATGTCCATGTTGCGGTGACGA
TTATGCTTGGGATGGGCGACTATAACGATGCCATTGAGGTCTACATCTCGCACAAGCGGTATATGGAGGCCCT
CATTCTCACCTGCGTGGCTTTTCCCAGCGTCTGGGAGCGTCAAGCTGCCATTGTGCGCAAATGGGGTGAGTGG
GCGGTCAAGCATGGCCAGCAGCAACTGGCAATTCGTTGCTTTGCCTGTACCGACCAGGAGTCCTCGGAGCCTT
GGACCTCTCCATCGGCTGCCCAGCTAAACTTCCAAAACATCACCCCGAGCATCCCCGAGGTGCTGAGCCCTCCG
CTGTCGCCCCCGGGCATTCAGAGAGGCCCCCAGCGCAGCGTCGCCAAGGCATCGGCACTGAAGCTGATTACGT
CCTTTGGAGATCCCACCCAAAAGGCCAAGTTCTACTCGCAGGCTGACGGCGGCCAGACACCAATTGCAGCTGG
AGTGACGCCCATTGCCGAGTCGGCCATCTCTCCGGGAGGCGCCTATGATCCCGCAACTGCGTTCCTCCGGCCG
TCGGGCAATAGCAGGTTCAACACGCCAACATCAGCCCGCCCTATCGGTCAGGGCTTCAGCCGCGGACGGCTGC
CCTCCATCGGAGAAGCCAACAAGCCCCTGGATAACATTGCAAGCATTGTGGACGCACCCCAGAAACGGCCGA
GCCATTCTCGCAAGTCGTCCGCCCCTCAAGATAACATGGCAACCGGGCTCGCCATGCAGCGCGCTGCTACGGC
CAGCCCAATGATGATGAGGGACCAGTACCAGCGCGCCGTGCAAGGGTACGGAGGAGAGCGACCGCCGTCTC
CCGACCATAACATCATGAGCAGACTGCAAGAGGTCCATTCGGCACAGCGAAACGGCTCCCGTGACCGGATTCC
TGCTCACCTTAGCCTGCAGCTGCAGACGATGCAGCCGCCATCGATGGAGGCAATGTCTCCTGAGCAATCCGGC
GCCTCATCCGCTCGCTTCCACTGGCCGTCTCGTCGCCGCGGTACTGGTCCTAGTTCCGCATCGTGGCCGGTTC
CATGACATCCACCTCCAGCGCTGGCCGGAGTCACAAATCGAACGCTCGACAAAGGGATGATTACATCCATAGC
CTGGAAGCGGCTCAGCACTATTCCAGGAGAGCTGGAAGCCGGACCGGAAGCAAGGAACGGACACGAGACGC
GTCCACCGGCCGCCACGCCAGCCGAGAGCGACGAACCAAGTCGCGCGACCCTTCGGAAGAGCGCGGCAGGG
CTTCAGCCAGATCCTGGACAAGGCCAAAGCGATCACCCACATCCCCAGTTCCAATGTCCCCCGAAGACTTGGCC
ATGCTGAGCAACCGGACATTCGACAACTCCGTGGAACCCCTCACGATTCGAAAGGCGAGCGTGGCGAAAGGC
AAGGCCAGCGGGCGGACATCCAGCCGCGGAAGGGGTGGATCAGTACCGCGGTCACCGCCGTCCCCGGTGCC
GCTGTCGGCAACAGCCCTGCATTATCAGGGATCGGAGGACGAGGAGGACTTTAGAGCAGCCATGCGGGCGCA
GGAAGAGTTCAGGGCCAAGCACAGCCGCAGCGTCGGCCACAACGTCAATTCTCCCGCCGTAAGCCGGCGTGA
GCATTCGGAAAGCCGACGAAAGGAAGCGACTGAGACTCGAGAGGCTGCACCCGTGGTCTTGAGCCAGACAGT
ATATGGACGAGCCGCTTCCACCGAGCACGCCGGCGATCTGAAGAAGATGAAGGACGAGAGACAGCGGAAGA
AGGAACAGGCTGCGCGAGAGCTAGAAGAGCGTAGGAAGTCTCTGGCCAAGCGACAGCTCGGTCCCCAGATTC
CCCATCCAAGCCAGATCTCTCCCGGGAGACCGCCGGTTCTGGTAGAGGCCGACGATGAAAAGCTGCCGGATG
ATCTGCCGCCGCGCTCTGCAACAGAACCCCCGAGGACGGCGGAGCCGCCGAGGAGCATGTATGCTCAAAACA
```

Figure 6B (Continued)

```
GGCCGCAGATTGGCCTGCCTGCCACTCCCAAGGCGATGAGGCTCATTATCCGGTCTGACGAGAATCAGTACGA
GGACCTCCCTGCTCCGCCGGTGCCGGCGACGTTTTCTCAAAAGTATTCGCCGCAGAACTCACCCCAGTACTCTC
CGAAATACACGTTGGGCAGTAGTGTTTATGGAGAGGAGCAGAAGCAGCAGCAGCAGCAGCAGCAACAGCAG
GGACAGCAGCAGCAGCAACAACGACAGCAACAACAACAGCAGCAGCAGCAACAGCAACAGCAGCAGCAGCA
ACAACAACAACTCTTTCATCAGAAAGAGGAGGAGCCGCCGTTGACACTGCTGCCATCGACTGTCTATCAGCTG
CCGTCCACTGTCTACCAACCGCCGTCTCGCCCCATGATTCCGCGAAGCATGTCGGCACCGATCCCTGATGAGCC
ACCTCACGCAATTCGATACGGGAGAAAGTCGAGTGCTAACGAGGGCAGAGGCCTCGACGATATTGTAGAGAC
GGAGTGGCGTCGACAAGTGAACAACCTGGTGCCGCCTCCACCACCACCTCCCCCTTCGGCGCCCCTGACTTTCC
TCAAGGAGCTGCAGCATCTAGCCGTGCCGCCCCCTCCTCCGCCAGCACCGCTGCCACACGTGCGACGCCAGCC
GCCCGTGGCTGGAACACTGGCCTCGGGCATGATCGAAATTGTCATGGACGATGACGAGGCAGAAGAGCCCAT
GTCGGCTGCTCCCAACGACGGCATGGTGCCGGTGCTCGCCCAGCCCGAACCCCCTGTCAAGGGCCACAACCGC
GGTCGCAGCCTCGGGGAGGGCAGCCTTTCCGGGCGTAGGACCAAGGCGACGGAGCGCCTCCGCTCGGGCAG
CCGCAGCCGCAAAGGATCCATCGGCGTCATGTCGCCCCCTCTCGAGATGTACGGCGGTGAGGGCAATGCCAA
CTCGCTGAACCAGCTCAGGTCGCCCGTGGTGGGCAATCCTCCGCCTGTGCTGTATGACCGGGACGCCATTCGA
TCGCCCATTGAGGGGCATGGCCGCAAGATGTCGATGGGGCTGCACGAGAACGGCATGTTTTAGGCTTGGGTG
GGCGACTTGTTGTGTCGCACAAGGAGTTGGGGCCTATTCGGTATTCGCTGTCAGGCTGTTCTTCGATGCCTGTA
TACGACGCCTGCATACGATGCGTTTGTCGCCATGACTTTGCTTGCTTTCATTGGCTCTGTTCTTTTCCGATCGAG
GAGGTTTCTTCCCCCCCCGTGCCTGGCATCTGTGAGCATGGGACGATATCTTGTGTGTCCCTTTGGGGCAATAT
TTCTTTTCAATTCTGATAGTTGGCATGGCCATTCCTTTGTCTTCTCTTCGTTCGGTCTTTCAGTTCTAAAGCCCTCC
CCCCTTCCTTTCCACTTGAGGAAAGAAGAAGCTGTCTTACTTCTTATCCAAGTGTGTTTAGTGAGCATGTGCAA
AACTGGGTGCTGGGATGCTTTCTCTTCATTTGCTTTGGCAACGTCATTATGTCCAGGGGATGGTTTTTTCATGG
AATGGCGGCTTGCAAATACCATGCAAGCTATGTATATCCCGGCTTGAAGACTCTTTTCTCGCTTTCCTTCACTGC
ATCTTTTTTTTTCTCTCTCTTCGATTCTTTATGACTGACGACGGGCACCTCTTTTTCTTTTTCTTTTTCTGGGCG
GAGGTATAAGAGAAGCAAGTAGGTGGTATGCGGAATCTAGACGGCTTTGATTTCCT
```

Figure 7A

| Vector | pFSG_complement_76887 | | |
|---|---|---|---|
| Position of elements | ID 76887 | 401 | 3794 |
| | GenR | 3795 | 6160 |
| | AmpR | 7323 | 8184 |

```
TCGCGCGTTTCGGTGATGACGGTGAAAACCTCTGACACATGCAGCTCCCGGAGACGGTCACAGCTTGTCTGTA
AGCGGATGCCGGGAGCAGACAAGCCCGTCAGGGCGCGTCAGCGGGTGTTGGCGGGTGTCGGGGCTGGCTTA
ACTATGCGGCATCAGAGCAGATTGTACTGAGAGTGCACCATATGCGGTGTGAAATACCGCACAGATGCGTAA
GGAGAAAATACCGCATCAGGCGCCATTCGCCATTCAGGCTGCGCAACTGTTGGGAAGGGCGATCGGTGCGGG
CCTCTTCGCTATTACGCCAGCTGGCGAAAGGGGGATGTGCTGCAAGGCGATTAAGTTGGGTAACGCCAGGGT
TTTCCCAGTCACGACGTTGTAAAACGACGGCCAGTGAATTCTTCTCTGATCGTTGGGCTATGAATAGTGCTGGG
AGCGAATCCATCAGACATCTCACTGGAATGTTTAATACCACCAGACTTGGCATTGCTTTTATGCCCAATATGAA
GGCTCAAAACTTAGCAGCTTGAATCGCTTGTTAACAGACCTCATCAAAAGATGCTCCATCAGCCTTTGAAAAGT
TGGAGGCGGGAGTCGATCCACAAGGTTCGATGACGACGGAGGCTGTCGAGGCCTTTTCCCAGCGATCCGAAG
ACTCCCCACAGACTCCGCATGCTCTGATGCTCAGCTGGCTGCTTGATTGGGCTGACGCTCCATGCTCTCCATAAT
CTCCATACCAGCAACAAGCTTTTTACGCATATCTTGAAGAATGACAGAACTTTGATACTATAAGCATTTATAAG
GTAGTAGAATAGTTCTTCGTGTAGGTAGGTAGCAGTAGTACTAGGCAACTCTACTCTGAGGCAACCTCGTACG
TAGTAGTAGTAGTGAGTAGCTTGTCGAGCCTCCTCCAGGCCACCCGCCGCTTGATCCGCCTGAAATAGCGTCG
CGTAGCTGATGAACCGAGCGCCACAAAGCGGAAAGACGAGCTTGGCGGCTCGAATCCAGGCGGACCGGAGC
AATAAAGTCCAGCACTAGTGGGTGTCCAAGAGGAGCTGCGCCGCGTTGCTCCAGCTTCAGCTCCGGCCAAGCT
CCAAGGTTCAAGAAAGTTGTCGGCAAGACGCGACTCGGAAAGGCTGTGGGCGTCTCTGCTCCTATGGAGCAG
TGCAGCCACCAGGCCAGAGGGGCTGCTTCACCGATAATGGCTAGGGGAGGAGGCCAGATGAATGGAAGATG
AGATCATGAAGGAGGACGTAAAGGCTCTTCTTACAAATAGTACTACTTTTACCCCGGAAACCGGACGAGCTGG
CAACGTTTGCTCTCCTTGTCCCGTCACTTTCGACCCTTGTCGCCGTCGTCCCCGCTAGCAGCAAGATCGTGCCGA
GATCTTGCTCTGTTGCTTTGGTGGTTTGCCGTGCTCTGTTTTCGTTGTCGTACGAACTCAGCCTACCTACTTATTC
TTTCTCTTATCCTAATACTTCATTCTGTATTACTCCCGTTCTCAGTTCTTCATCCCTTTGCTTCCGGTTTTTGATCAA
TATACTTTACAGGGAGAGGAGAAGAGAAGAGAAGCGGAAGGGAAGTGACAGGAAGAGAGAGAGAGGGGA
TAGAAGAAGAGTCGGCAGAGCTCTCAGCGCAACCATGAGGCCGCCAACGTCGTTGTCAGCAGCTCTGACGCT
GCTCCTCGCGACGGATTACATTGAAGCCATCGCTACTCCCGTTTTCCCGAGGGCGAAATCTGGGGATGGGTAT
TTGGCGATTCCCGTGGGAACCATCCCGAGGCCGCACAAGGTCGGCAAGAGAAGCGCCATCGATGCTACGCTA
CAGAACATGGACTTTTTCTATGCCATTCAAGGTAATGCATCACCTTTGTTAACACCACCAGAAGCTTCTGTTCAG
CTCGTGTCTCTATCGTCCGCTTTTAAGTGCACTATCTACGGTCTGCAAAGTGTACATGCTAATAAATGGTCGGCA
ACAGTCGGCATGGGAACGCCTCCCCAGAATGTGACCGTCCTCGTCGACACGGGATCCAGCGAGCTATGGGTC
AATCCCGACTGCTCAACCGCGCCGTCCCAGCAACAGGCCGACATGTGCGAGAATCTGGGCCAGTACAACCCCA
GGAAATCAAGAACACCGCCCGTCGGCCCGTTTGGGCGTGAAGAGATCAACTATGGCGACCCTACGGACCAGT
CCACGCAGACGTCGGTCGACATTACCTACTATGCCGACACGCTGAGCTTTGGCAGCATCCAGGTCAAGAACCA
GACGTTTGGCGTCGTCACGGCCAGCGACGGCCAGGCGCAGGGCATCATGGGCCTCGCACCCGACGTCCGGGG
CGGATTCCCGGGAGACGAGCCGTACAGCCTGCTGCTCAACACCATGGCCGAGCAGGGTGTCATTGCAAGCCG
```

Figure 7A (Continued)

AGTCTTTGCACTCGATCTCCGGCACTCCGACTCGGAGACAGGCGCCATCATCTACGGCGGCCTCGATCGCAGC
AAGTTTGTCGGCTCTCTCGAAGCACGTCCGATTGTGCGCGGCATCAAGGGCGAAACTCGGCTGGCCGTCAACC
TCACGACGCTGGGCCTCACCCTGGGCCGGTCCCAGAGCTTCCGGCTCTCTGCTGCCGACACCAACGTGATGCTC
GACTCCGGCACGACGCTCAGCCGGATGCACGAGGCTGCTGCCATTCCCATCCTCGAGGCCCTGGGCGCCCAAG
ACGCCGGCGAGGGCTACTTCTACGTGCCGTGCTCGACCCGGAACGCTGGCGGCAGTGTAGATTTCGGCTTCG
GCAACAAGGTTGTCCGCGTCCCCTTTTCCGACTTTATACTGACGGGCGAAGACTCGAGCGACTCAGACTATTGC
TTCGTTGGCATCGTCATCACCACCGACCAGCAGATTCTGGGCGACACGGTGCTGCGGGCCGGATACTTTGTCTT
TGACTGGGACAACCGGGAGGTTCACATTGCCCAGGCCGCGGATTGCGGCAGCAGTGACATTGTTGTTGCTGG
CAGGGGGTCCGATGCCGTTCCCAGCGTTCAGGGGAACTGCAATGAGAACGAAGCGTTTCCCACCGGCTCAGG
AAGCCCAACGGTAAGCATCTCTTTTGTCCAAACTGCGTGACAACCGACGACTAACCACAAGTCTCGCTGCAGAT
CACTGCATCCAACTCCGGAGCCACCAACTTGATCCCGACCTCGGCCTTCACGACGACGTTTACGGTGACGTCCT
GCCCGGTCTTCGACATCAACTGCCGCACCGGCGTCGTCACGACGCGGACGGTTCGGCCAGCTGAAGCCACTGC
CGAACCTACAAGCACCAGCTCTCCCAGCGGCTCCGGCAGCGGCGACGGGGATGGCGGAGGTGATGAAGACG
CTGGTGTACGGCTTGTCCCTTTTACCTGGGTGCTCGTGGCGCTGGGCACCCTGGCAATGTTTGTCAACATTGTA
TAAATTGTCCAGGAGGTCATTTCTCTTGGATAGGTACTCAGAGCTTGTTTACACGTTTCGAAGCTTTTGTATATA
CGGGTGAGCTGGATCGGCCGACATTAATGGGCATTCGCGATTAGGTAGAGGATTTATCCTAGGATCTTGAATA
TGAGGCAGGGGATTTGAATAGACGGACGATGCATTGTCTTTGGTTTTCTGCAAAAGGCACCAGCCTGGTCAAC
GCGTAATACCCATGACATTGATGATTGTAGGTAGTATGTCATGTAGAAACGGGTCTTTGTGAAGTGGAAGTAT
CAGTAAGCCGTATAGTTGGCCTTTTCTGTCTCACGGGGTGACTGCATGCACCTTTGTCTTGTCGAGGCATCTAG
ACGGCTTTGATTTCCTTCAGGTCATACGAGGCTTGTGCAATGGTCTCCGCATGGATCGCTGCTGTTCTCCTATCA
AACTCGGATTTTGTCTTAGGGGATGGCGTAGGAAAGACGCTGCCGCGGTTCAGAAGCACCTCGATGCTATCAG
GATGTGACAAAAACGACTCGAAAACCCGGATTCATCGGTGATGCTTTCGGGATCGCAAGCGTAAAGAAAGAC
TCTCTTCCAAGACCTAGAAGTATAGCAAAATCAGCAGCAGACCATCAATGTATAGCGAATGCGCCCATACAAA
AGCTGAACGTCCCCGGAGAAGCACTTGTCCAGGGACGGGAAATAGGCTTCCGGAACGGGAGCCATTGGCAGC
ACAGCTATATCATTCTAAGTAAACAAATGTAATGAGCAAGCGGACGGAGTGCTGAAACCTCCGTATGCCTGAA
GCCGACGAAAGCGCGTTGGATTAGAGGTCGACAGAAGATGATATTGAAGGAGCACTTTTTGGGCTTGGCTGG
AGCTAGTGGAGGTCAACAATGAATGCCTATTTTGGTTTAGTCGTCCAGGCGGTGAGCACAAAATTTGTGTCGT
TTGACAAGATGGTTCATTTAGGCAACTGGTCAGATCAGCCCCACTTGTAGCAGTAGCGGCGGCGCTCGAAGTG
TGACTCTTATTAGCAGACAGGAACGAGGACATTATTATCATCTGCTGCTTGGTGCACGATAACTTGGTGCGTTT
GTCAAGCAAGGTAAGTGAACGACCCGGTCATACCTTCTTAAGTTCGCCCTTCCTCCCTTTATTTCAGATTCAATC
TGACTTACCTATTCTACCCAAGCATCGATATGATTGAACAAGATGGATTGCACGCAGGTTCTCCGGCCGCTTGG
GTGGAGAGGCTATTCGGCTATGACTGGGCACAACAGACAATCGGCTGCTCTGATGCCGCCGTGTTCCGGCTGT
CAGCGCAGGGGCGCCCGGTTCTTTTTGTCAAGACCGACCTGTCCGGTGCCCTGAATGAACTGCAGGACGAGGC
AGCGCGGCTATCGTGGCTGGCCACGACGGGCGTTCCTTGCGCAGCTGTGCTCGACGTTGTCACTGAAGCGGG
AAGGGACTGGCTGCTATTGGGCGAAGTGCCGGGGCAGGATCTCCTGTCATCTCACCTTGCTCCTGCCGAGAAA
GTATCCATCATGGCTGATGCAATGCGGCGGCTGCATACGCTTGATCCGGCTACCTGCCCATTCGACCACCAAGC
GAAACATCGCATCGAGCGAGCACGTACTCGGATGGAAGCCGGTCTTGTCGATCAGGATGATCTGGACGAAGA
GCATCAGGGGCTCGCGCCAGCCGAACTGTTCGCCAGGCTCAAGGCGCGCATGCCCGACGGCGAGGATCTCGT
CGTGACCCATGGCGATGCCTGCTTGCCGAATATCATGGTGGAAAATGGCCGCTTTTCTGGATTCATCGACTGTG
GCCGGCTGGGTGTGGCGGACCGCTATCAGGACATAGCGTTGGCTACCCGTGATATTGCTGAAGAGCTTGGCG
GCGAATGGGCTGACCGCTTCCTCGTGCTTTACGGTATCGCCGCTCCCGATTCGCAGCGCATCGCCTTCTATCGC
CTTCTTGACGAGTTCTTCTGAGGATCCACTTAACGTTACTGAAATCATCAAACAGCTTGACGAATCTGGATATA
AGATCGTTGGTGTCGATGTCAGCTCCGGAGTTGAGACAAATGGTGTTCAGGATCTCGATAAGATACGTTCATT

Figure 7A (Continued)

TGTCCAAGCAGCAAAGAGTGCCTTCTAGTGATTTAATAGCTCCATGTCAACAAGAATAAAACGCGTTTCGGGTT
TACCTCTTCCAGATACAGCTCATCTGCAATGCATTAATGCATTGGACCTCGCAACCCTAGTACGCCCTTCAGGCT
CCGGCGAAGCAGAAGAATAGCTTAGCAGAGTCTATTTTCATTTTCGGGAGACGAGATCAAGCAGATCAACGGT
CGTCAAGAGACCTACGAGACTGAGGAATCCGCTCTTGGCTCCACGCGACTATATATTTGTCTCTAATTGTACTTT
GACATGCTCCTCTTCTTTACTCTGATAGCTTGACTATGAAAATTCCGTCACCAGCCCCTGGGTTCGCAAAGATAA
TTGCACTGTTTCTTCCTTGAACTCTCAAGCCTACAGGACACACATTCATCGTAGGTATAAACCTCGAAAATCATT
CCTACTAAGATGGGTATACAATAGTAACCATGGTTGCCTAGTGAATGCTCCGTAACACCCAATACGCCGGCCG
AAACTTTTTTACAACTCTCCTATGAGTCGTTTACCCAGAATGCACAGGTACACTTGTTTAGAGGTAATCCAAGCT
TGGCGTAATCATGGTCATAGCTGTTTCCTGTGTGAAATTGTTATCCGCTCACAATTCCACACAACATACGAGCC
GGAAGCATAAAGTGTAAAGCCTGGGGTGCCTAATGAGTGAGCTAACTCACATTAATTGCGTTGCGCTCACTGC
CCGCTTTCCAGTCGGGAAACCTGTCGTGCCAGCTGCATTAATGAATCGGCCAACGCGCGGGGAGAGGCGGTTT
GCGTATTGGGCGCTCTTCCGCTTCCTCGCTCACTGACTCGCTGCGCTCGGTCGTTCGGCTGCGGCGAGCGGTAT
CAGCTCACTCAAAGGCGGTAATACGGTTATCCACAGAATCAGGGGATAACGCAGGAAAGAACATGTGAGCAA
AAGGCCAGCAAAAGGCCAGGAACCGTAAAAAGGCCGCGTTGCTGGCGTTTTTCCATAGGCTCCGCCCCCCTGA
CGAGCATCACAAAAATCGACGCTCAAGTCAGAGGTGGCGAAACCCGACAGGACTATAAAGATACCAGGCGTT
TCCCCCTGGAAGCTCCCTCGTGCGCTCTCCTGTTCCGACCCTGCCGCTTACCGGATACCTGTCCGCCTTTCTCCCT
TCGGGAAGCGTGGCGCTTTCTCAATGCTCACGCTGTAGGTATCTCAGTTCGGTGTAGGTCGTTCGCTCCAAGCT
GGGCTGTGTGCACGAACCCCCCGTTCAGCCCGACCGCTGCGCCTTATCCGGTAACTATCGTCTTGAGTCCAACC
CGGTAAGACACGACTTATCGCCACTGGCAGCAGCCACTGGTAACAGGATTAGCAGAGCGAGGTATGTAGGCG
GTGCTACAGAGTTCTTGAAGTGGTGGCCTAACTACGGCTACACTAGAAGGACAGTATTTGGTATCTGCGCTCT
GCTGAAGCCAGTTACCTTCGGAAAAAGAGTTGGTAGCTCTTGATCCGGCAAACAAACCACCGCTGGTAGCGGT
GGTTTTTTTGTTTGCAAGCAGCAGATTACGCGCAGAAAAAAAGGATCTCAAGAAGATCCTTTGATCTTTTCTAC
GGGGTCTGACGCTCAGTGGAACGAAAACTCACGTTAAGGGATTTTGGTCATGAGATTATCAAAAAGGATCTTC
ACCTAGATCCTTTTAAATTAAAAATGAAGTTTTAAATCAATCTAAAGTATATATGAGTAAACTTGGTCTGACAGT
TACCAATGCTTAATCAGTGAGGCACCTATCTCAGCGATCTGTCTATTTCGTTCATCCATAGTTGCCTGACTCCCC
GTCGTGTAGATAACTACGATACGGGAGGGCTTACCATCTGGCCCCAGTGCTGCAATGATACCGCGAGACCCAC
GCTCACCGGCTCCAGATTTATCAGCAATAAACCAGCCAGCCGGAAGGGCCGAGCGCAGAAGTGGTCCTGCAA
CTTTATCCGCCTCCATCCAGTCTATTAATTGTTGCCGGGAAGCTAGAGTAAGTAGTTCGCCAGTTAATAGTTTGC
GCAACGTTGTTGCCATTGCTACAGGCATCGTGGTGTCACGCTCGTCGTTTGGTATGGCTTCATTCAGCTCCGGT
TCCCAACGATCAAGGCGAGTTACATGATCCCCCATGTTGTGCAAAAAAGCGGTTAGCTCCTTCGGTCCTCCGAT
CGTTGTCAGAAGTAAGTTGGCCGCAGTGTTATCACTCATGGTTATGGCAGCACTGCATAATTCTCTTACTGTCA
TGCCATCCGTAAGATGCTTTTCTGTGACTGGTGAGTACTCAACCAAGTCATTCTGAGAATAGTGTATGCGGCGA
CCGAGTTGCTCTTGCCCGGCGTCAATACGGGATAATACCGCGCCACATAGCAGAACTTTAAAAGTGCTCATCAT
TGGAAAACGTTCTTCGGGGCGAAAACTCTCAAGGATCTTACCGCTGTTGAGATCCAGTTCGATGTAACCCACTC
GTGCACCCAACTGATCTTCAGCATCTTTTACTTTCACCAGCGTTTCTGGGTGAGCAAAAACAGGAAGGCAAAAT
GCCGCAAAAAAGGGAATAAGGGCGACACGGAAATGTTGAATACTCATACTCTTCCTTTTTCAATATTATTGAAG
CATTTATCAGGGTTATTGTCTCATGAGCGGATACATATTTGAATGTATTTAGAAAAATAAACAAATAGGGGTTC
CGCGCACATTTCCCCGAAAAGTGCCACCTGACGTCTAAGAAACCATTATTATCATGACATTAACCTATAAAAAT
AGGCGTATCACGAGGCCCTTTCGTC

Annotation:      Aspartyl protease
Number of exons: 2
                 promoter     1      1262
Position of      exon 1       1263   1476
elements         exon 2       1600   2726
                 terminator   2727   3436
```

TAAAACGACGGCCAGTGAATTCTTCTCTGATCGTTGGGCTATGAATAGTGCTGGGAGCGAATCCATCAGACAT
CTCACTGGAATGTTTAATACCACCAGACTTGGCATTGCTTTTATGCCCAATATGAAGGCTCAAAACTTAGCAGC
TTGAATCGCTTGTTAACAGACCTCATCAAAAGATGCTCCATCAGCCTTTGAAAAGTTGGAGGCGGGAGTCGAT
CCACAAGGTTCGATGACGACGGAGGCTGTCGAGGCCTTTTCCCAGCGATCCGAAGACTCCCCACAGACTCCGC
ATGCTCTGATGCTCAGCTGGCTGCTTGATTGGGCTGACGCTCCATGCTCTCCATAATCTCCATACCAGCAACAA
GCTTTTTACGCATATCTTGAAGAATGACAGAACTTTGATACTATAAGCATTTATAAGGTAGTAGAATAGTTCTTC
GTGTAGGTAGGTAGCAGTAGTACTAGGCAACTCTACTCTGAGGCAACCTCGTACGTAGTAGTAGTAGTGAGTA
GCTTGTCGAGCCTCCTCCAGGCCACCCGCCGCTTGATCCGCCTGAAATAGCGTCGCGTAGCTGATGAACCGAG
CGCCACAAAGCGGAAAGACGAGCTTGGCGGCTCGAATCCAGGCGGACCGGAGCAATAAAGTCCAGCACTAGT
GGGTGTCCAAGAGGAGCTGCGCCGCGTTGCTCCAGCTTCAGCTCCGGCCAAGCTCCAAGGTTCAAGAAAGTTG
TCGGCAAGACGCGACTCGGAAAGGCTGTGGGCGTCTCTGCTCCTATGGAGCAGTGCAGCCACCAGGCCAGAG
GGGCTGCTTCACCGATAATGGCTAGGGGAGGAGGCCAGATGAATGGAAGATGAGATCATGAAGGAGGACGT
AAAGGCTCTTCTTACAAATAGTACTACTTTTACCCCGGAAACCGGACGAGCTGGCAACGTTTGCTCTCCTTGTCC
CGTCACTTTCGACCCTTGTCGCCGTCGTCCCCGCTAGCAGCAAGATCGTGCCGAGATCTTGCTCTGTTGCTTTG
GTGGTTTGCCGTGCTCTGTTTTCGTTGTCGTACGAACTCAGCCTACCTACTTATTCTTTCTCTTATCCTAATACTTC
ATTCTGTATTACTCCCGTTCTCAGTTCTTCATCCCTTTGCTTCCGGTTTTTGATCAATATACTTTACAGGGAGAGG
AGAAGAGAAGAGAAGCGGAAGGGAAGTGACAGGAAGAGAGAGAGAGGGGATAGAAGAAGAGTCGGCAGA
GCTCTCAGCGCAACCATGAGGCCGCCAACGTCGTTGTCAGCAGCTCTGACGCTGCTCCTCGCGACGGATTACA
TTGAAGCCATCGCTACTCCCGTTTTCCCGAGGGCGAAATCTGGGGATGGGTATTTGGCGATTCCCGTGGGAAC
CATCCCGAGGCCGCACAAGGTCGGCAAGAGAAGCGCCATCGATGCTACGCTACAGAACATGGACTTTTTCTAT
GCCATTCAAGGTAATGCATCACCTTTGTTAACACCACCAGAAGCTTCTGTTCAGCTCGTGTCTCTATCGTCCGCT
TTTAAGTGCACTATCTACGGTCTGCAAAGTGTACATGCTAATAAATGGTCGGCAACAGTCGGCATGGGAACGC
CTCCCCAGAATGTGACCGTCCTCGTCGACACGGGATCCAGCGAGCTATGGGTCAATCCCGACTGCTCAACCGC
GCCGTCCCAGCAACAGGCCGACATGTGCGAGAATCTGGGCCAGTACAACCCCAGGAAATCAAGAACACCGCC
CGTCGGCCCGTTTGGGCGTGAAGAGATCAACTATGGCGACCCTACGGACCAGTCCACGCAGACGTCGGTCGA
CATTACCTACTATGCCGACACGCTGAGCTTTGGCAGCATCCAGGTCAAGAACCAGACGTTTGGCGTCGTCACG
GCCAGCGACGGCCAGGCGCAGGGCATCATGGGCCTCGCACCCGACGTCCGGGGCGGATTCCCGGGAGACGA
GCCGTACAGCCTGCTGCTCAACACCATGGCCGAGCAGGGTGTCATTGCAAGCCGAGTCTTTGCACTCGATCTCC
GGCACTCCGACTCGGAGACAGGCGCCATCATCTACGGCGGCCTCGATCGCAGCAAGTTTGTCGGCTCTCTCGA

Figure 7B (Continued)

AGCACGTCCGATTGTGCGCGGCATCAAGGGCGAAACTCGGCTGGCCGTCAACCTCACGACGCTGGGCCTCACC
CTGGGCCGGTCCCAGAGCTTCCGGCTCTCTGCTGCCGACACCAACGTGATGCTCGACTCCGGCACGACGCTCA
GCCGGATGCACGAGGCTGCTGCCATTCCCATCCTCGAGGCCCTGGGCGCCCAAGACGCCGGCGAGGGCTACT
TCTACGTGCCGTGCTCGACCCGGAACGCTGGCGGCAGTGTAGATTTCGGCTTCGGCAACAAGGTTGTCCGCGT
CCCCTTTTCCGACTTTATACTGACGGGCGAAGACTCGAGCGACTCAGACTATTGCTTCGTTGGCATCGTCATCA
CCACCGACCAGCAGATTCTGGGCGACACGGTGCTGCGGGCCGGATACTTTGTCTTTGACTGGGACAACCGGG
AGGTTCACATTGCCCAGGCCGCGGATTGCGGCAGCAGTGACATTGTTGTTGCTGGCAGGGGGTCCGATGCCG
TTCCCAGCGTTCAGGGGAACTGCAATGAGAACGAAGCGTTTCCCACCGGCTCAGGAAGCCCAACGGTAAGCA
TCTCTTTTGTCCAAACTGCGTGACAACCGACGACTAACCACAAGTCTCGCTGCAGATCACTGCATCCAACTCCG
GAGCCACCAACTTGATCCCGACCTCGGCCTTCACGACGACGTTTACGGTGACGTCCTGCCCGGTCTTCGACATC
AACTGCCGCACCGGCGTCGTCACGACGCGGACGGTTCGGCCAGCTGAAGCCACTGCCGAACCTACAAGCACC
AGCTCTCCCAGCGGCTCCGGCAGCGGCGACGGGGATGGCGGAGGTGATGAAGACGCTGGTGTACGGCTTGT
CCCTTTTACCTGGGTGCTCGTGGCGCTGGGCACCCTGGCAATGTTTGTCAACATTGTATAAATTGTCCAGGAGG
TCATTTCTCTTGGATAGGTACTCAGAGCTTGTTTACACGTTTCGAAGCTTTTGTATATACGGGTGAGCTGGATC
GGCCGACATTAATGGGCATTCGCGATTAGGTAGAGGATTTATCCTAGGATCTTGAATATGAGGCAGGGGATTT
GAATAGACGGACGATGCATTGTCTTTGGTTTTCTGCAAAAGGCACCAGCCTGGTCAACGCGTAATACCCATGA
CATTGATGATTGTAGGTAGTATGTCATGTAGAAACGGGTCTTTGTGAAGTGGAAGTATCAGTAAGCCGTATAG
TTGGCCTTTTCTGTCTCACGGGGTGACTGCATGCACCTTTGTCTTGTCGAGGCATCTAGACGGCTTTGATTTCCT

Figure 8A

| Vector | pFSG_complement_59270 | | |
|---|---|---|---|
| Position of elements | ID 59270 | 401 | 4206 |
| | GenR | 4207 | 6572 |
| | AmpR | 7735 | 8596 |

TCGCGCGTTTCGGTGATGACGGTGAAAACCTCTGACACATGCAGCTCCCGGAGACGGTCACAGCTTGTCTGTA
AGCGGATGCCGGGAGCAGACAAGCCCGTCAGGGCGCGTCAGCGGGTGTTGGCGGGTGTCGGGGCTGGCTTA
ACTATGCGGCATCAGAGCAGATTGTACTGAGAGTGCACCATATGCGGTGTGAAATACCGCACAGATGCGTAA
GGAGAAAATACCGCATCAGGCGCCATTCGCCATTCAGGCTGCGCAACTGTTGGGAAGGGCGATCGGTGCGGG
CCTCTTCGCTATTACGCCAGCTGGCGAAAGGGGGATGTGCTGCAAGGCGATTAAGTTGGGTAACGCCAGGGT
TTTCCCAGTCACGACGTTGTAAAACGACGGCCAGTGAATTCCGCCAGGTTGATCTTGTTCTACAGAGGCCAGC
GACTCAGCATAATTGCTTGTTCGAGCGGATTAGACAGATCAGTGCAGCCCTCGTCAGGCACAAGGCACGAGTC
GAAGATATGCCCCAACCCGCAGCTCCAGCGCCCGTACCCAAGTCTTGTTGCCTTTGTGCCACATTCTGTACCCA
GCTGCCTAAGACGTAGCATTGGACATGTGATGCAGATGTATTTGTAGGGGGTATCGGGAAGTGCCCGTGTGCT
TCGCGATGAGATTCCGCAGATTTACACCCTGAACCGCTACCCTACAATACCTTACATCTTACAAGTCTACAAGG
GTAAAATACGTCGGCATGTGCGAGTACCAAACCACAATATGCCAACTTCCGCTATCTACTCACCTTTGATATATT
CCCCACGTACAATTATTCTGCCTTTTCGTTGGGTTACCGCTACTGGTCCTCGGCTGATACATGAAGGCGGATTAT
CATCCTGGTGTTGTGGATCAGCTGCAATCGAATGGGCTCTACGCAATCATATGAGGAAACATCAGCATAAACA
ATAATATGCTAAACGTCAGATTAGAGAAAAGCAATGAGTAGAATGACAACCTGACGAGAGTTCACGTTGTGAA
CAAGCCTCGAGGCTGTTCAAGGCTCGGACCCAACAGGGAATACTTACTACTAGGTATGGAGATCAAGCCTCGT
AAAGCCGGGTTATGACTCTGTTCAGCACCTTATCTTAGTGGGGTGGTCGCCGGTTGACTCAACATCATTCCAGC
CTCGTCATAGAGGGGCAACTCTTCAGCCTTTTCTACCACCGCAACTCCCCTCTTGCTCGCGACAAATACCTTGGT
CGCACAGCTCTTTGCTGTTCACGCGTCTTTCTTTTGCTTCGACAGTTTAAATACAGAAGCCGCCTTGCTTGCCGT
AGGATTCAACGACGCTCCATACCCGCAGCCTCCCCGGGACTTGACACAATGGCTCAGAACCCGGCAGACGAGC
TCCTTCGGCGTCCGTTATATGGTAAGTAAAAGCACTTTGTCGCGCCACTGGCAAGGCCTACCAATACCGGCCGA
GACACGGGACACGAGACATACAGCTTATAGGACACGCGCTGTTTCTTGCCCGAGTCTCGATTCGATTCTACGAT
CTCTGAACAAGTGCTGACAACTTGCGCCAACGCGGTCTTAGTCTACGATCTTCCACCAGAAAGCCTCGCAGGCT
TGACGCTGAAACCGGACGCAGACGCCATCGCCATCGAGGAACCCGAGACGTCAACGACTCCCAGCCAGGCTT
CGGACTCGTCCTCCGACAGCTTTGTCGGTTCCCAAGCATGCTCTCTCTGCAAGCTTTCCTTCACCACCGTAATAG
ACCAGCGAAGTCACATCAAGTCCGATTTCCACAACTACAATCTCAAGCAGAAGCTGCGGGGTCAGGGCCCGGT
CTCAGAGACCGAGTTCGAAAAGCTGATTGAGACTCTGGACGAATCGCTCTCGGGCTCCGACTCGGAAGATTCG
GAAGACGACGAGGACGAAGGGCGTCAGGATTCTACGCTTACGGCGCTGCTTAAGAAGCAAGCAAAGCTGAC
GGAGAGACGAAACGCCACCAGAGAGAATAACAAACAAGGCGATAATGACGACGATGAACTCTCAGGAAGGC
CAGGCAAGGGGAAGCCGGCGCTGATATGGTTCAGCTCGCCGTTGCTTCCAGAAAACACGTATTTCGGCATCTA
CCGAGCGATATTTACAGATGAAGAGCAACGCCAGCCCGACTTGGTCGAGGTCATCCGGAAGAAGCAGCTCGA
GCCCATAGCCATGCCTAAGCCTGCAAAAGACGGGACGCTGCCGCCGATCGCGTACAAGGGGCCGCACTTCTTC
CTCTGCATGATCGGAGGCGGCCATTTTGCCGCCATGGTCGTCTCCCTCGCGCCGAGAGCCGCCAAATCGGGCA
GCACAACCATGAACCGAGAGGCCACGGTCCTCGCCCACAAGACCTTTCACAGATACACGACGCGTCGAAAACA

Figure 8A (Continued)

```
GGGTGGTTCTCAGTCGGCGAACGACAACGCCAAAGGCAAAGCGCACTCTGTCGGCTCGTCTCTGCGTCGGTAC
AACGAAACCGCCCTGGTCGAGGATGTGCGCGCTCTTCTCCAGGACTGGAAGGGGCTCTTGGACTCTTCCGAAC
TGCTTTTCATCAGGGCAACAGGAACGACAAATAGGAGAACCCTGTTCGGCCCCTATGAAGGACAAGTTCTTCA
AGCCAACGACGCTCGTATCCGAGGGTTTCCATTTAGTACCAGGAGAGCTACTCAGAACGAGCTGATGCGGTCC
TTCATCGAGCTAACTCGACTCAAAGTCAGGGAGATTGCTCCAAGCAAGGCAGGACTAGACAAGGCGAACGCG
GCACCAAGCAAACCTGCGACACCATCCAAGCCGGCAAAGCCGACGTTGTCAGAAGAGGAGGAAACGGCGCTG
CTTCATACGTCTCAGCTACAAGCCTTTGTACGGCGGTCCAAGCTACCTGCACTTTTATCGTACCTCACAAAAAAT
AACCTGGATCCGGACTTTGAGTTCTATCCTCCGGAACAAAACTACCATACACCACGCCTTTTACACTACGCAGCT
GCTCAGAACTCTGCTCCTTTGGTGCTGGGGATCCTTACACGAGCCGGGGCGAACCCGTTGCTCAAGAACGCGG
AGGGAAAGACGCCCTTCGAGCTCGCTGGAGATCGCTCTACGCGGGATGCCTTTAGAGTAGCCCGCTCTGAAGT
AGGAGAGGGGAAATGGGACTGGGATGCGGCCAAGGTTCCTCCCGCCATGACCAAGGACGAGGCAGATCGCC
GTGACGAGCGGGAAAAGCAAGAAGCAGATAAGAAGGAGTCCGACAGGAGAAAAGCGGAAGAAGAGAGGCT
CCGTACTGAAGGGCCAAGGCTCCCTGAGCAGAAGACGAAGAAGGGAAACAGCATAGCGTCCATAATCGCCAA
GACGCCACAAGAGCGCAGGGAGGAGGAAGCCAGGGGGCTGACGCCCGAGATGAAGTTGAAACTGGAACGA
GAAAGACGAGCGCGAGCGGCAGAAGAGAGAATCAAGAGGCTACAGGGTGGTAGTTGAATATATGCTTCCTG
TGAGACAGCTAAGCCACGTAGTAGACGTAGGTAGGTAGGTAGGTAGCTCATGCTGGCATCAATATCGATCTAT
CTGACCTTGAAATCACCTTTGGCTAGGTTGCCAGCCGTTCACTTATGATTCCTAGGACGAAATACCCATCAAGC
AACTGAACAACACAGCAGTTGTATCTATTCAGAACCTTTCTTGCCGTAGCACCACACGTGAAATGCTCAGCGCG
TGTCCTCGACTGGCCTACAACAGAGGAGGCACTCCCAAGATATGCGTACATAGTCCACGTCTAGCCCGAGTTG
AAATCAAACATATGCCATACAGGCCTTCGTGCATCTTTTGGATGAACACCAACAGCATCACCATCATGCACAAC
GCCCTGGTAGGGCATAAAAGGGGGGAATATGCCCAAGTGCTCTTTCTTCTTCTTGAATGCGAAAGTTCTTCAC
GAGAACACGGAAGTCTCATCCAGCACGCGGATGCACCAAGCATCTTCGCTTAAGACGCTCCCATGAACGGGTG
GCAGTCACGACGGGCAAGTGGTCCGATGCCGAAGAGTGGCAGCTGCAAGAGCGCCTGAACCACTGCCGAGG
GTTTCCACTCCCACACTCCCACACTCCCACAAATTGCTCTCCTGGAAACGACATGTTCTCCCACAAACATTTCTTC
CTTCACGATACCCAACATTTCTCTCATTCCAGCCTACACTTCGATCTAGACGGCTTTGATTTCCTTCAGGTCATAC
GAGGCTTGTGCAATGGTCTCCGCATGGATCGCTGCTGTTCTCCTATCAAACTCGGATTTTGTCTTAGGGGATGG
CGTAGGAAAGACGCTGCCGCGGTTCAGAAGCACCTCGATGCTATCAGGATGTGACAAAAACGACTCGAAAAC
CCGGATTCATCGGTGATGCTTTCGGGATCGCAAGCGTAAAGAAAGACTCTCTTCCAAGACCTAGAAGTATAGC
AAAATCAGCAGCAGACCATCAATGTATAGCGAATGCGCCCATACAAAAGCTGAACGTCCCCGGAGAAGCACTT
GTCCAGGGACGGGAAATAGGCTTCCGGAACGGGAGCCATTGGCAGCACAGCTATATCATTCTAAGTAAACAA
ATGTAATGAGCAAGCGGACGGAGTGCTGAAACCTCCGTATGCCTGAAGCCGACGAAAGCGCGTTGGATTAGA
GGTCGACAGAAGATGATATTGAAGGAGCACTTTTTGGGCTTGGCTGGAGCTAGTGGAGGTCAACAATGAATG
CCTATTTTGGTTTAGTCGTCCAGGCGGTGAGCACAAAATTTGTGTCGTTTGACAAGATGGTTCATTTAGGCAAC
TGGTCAGATCAGCCCCACTTGTAGCAGTAGCGGCGGCGCTCGAAGTGTGACTCTTATTAGCAGACAGGAACGA
GGACATTATTATCATCTGCTGCTTGGTGCACGATAACTTGGTGCGTTTGTCAAGCAAGGTAAGTGAACGACCC
GGTCATACCTTCTTAAGTTCGCCCTTCCTCCCTTTATTTCAGATTCAATCTGACTTACCTATTCTACCCAAGCATC
GATATGATTGAACAAGATGGATTGCACGCAGGTTCTCCGGCCGCTTGGGTGGAGAGGCTATTCGGCTATGACT
GGGCACAACAGACAATCGGCTGCTCTGATGCCGCCGTGTTCCGGCTGTCAGCGCAGGGGCGCCCGGTTCTTTT
TGTCAAGACCGACCTGTCCGGTGCCCTGAATGAACTGCAGGACGAGGCAGCGCGGCTATCGTGGCTGGCCAC
GACGGGCGTTCCTTGCGCAGCTGTGCTCGACGTTGTCACTGAAGCGGGAAGGGACTGGCTGCTATTGGGCGA
AGTGCCGGGGCAGGATCTCCTGTCATCTCACCTTGCTCCTGCCGAGAAAGTATCCATCATGGCTGATGCAATGC
GGCGGCTGCATACGCTTGATCCGGCTACCTGCCCATTCGACCACCAAGCGAAACATCGCATCGAGCGAGCACG
TACTCGGATGGAAGCCGGTCTTGTCGATCAGGATGATCTGGACGAAGAGCATCAGGGGCTCGCGCCAGCCGA
```

Figure 8A (Continued)

ACTGTTCGCCAGGCTCAAGGCGCGCATGCCCGACGGCGAGGATCTCGTCGTGACCCATGGCGATGCCTGCTTG
CCGAATATCATGGTGGAAAATGGCCGCTTTTCTGGATTCATCGACTGTGGCCGGCTGGGTGTGGCGGACCGCT
ATCAGGACATAGCGTTGGCTACCCGTGATATTGCTGAAGAGCTTGGCGGCGAATGGGCTGACCGCTTCCTCGT
GCTTTACGGTATCGCCGCTCCCGATTCGCAGCGCATCGCCTTCTATCGCCTTCTTGACGAGTTCTTCTGAGGATC
CACTTAACGTTACTGAAATCATCAAACAGCTTGACGAATCTGGATATAAGATCGTTGGTGTCGATGTCAGCTCC
GGAGTTGAGACAAATGGTGTTCAGGATCTCGATAAGATACGTTCATTTGTCCAAGCAGCAAAGAGTGCCTTCT
AGTGATTTAATAGCTCCATGTCAACAAGAATAAAACGCGTTTCGGGTTTACCTCTTCCAGATACAGCTCATCTG
CAATGCATTAATGCATTGGACCTCGCAACCCTAGTACGCCCTTCAGGCTCCGGCGAAGCAGAAGAATAGCTTA
GCAGAGTCTATTTTCATTTTCGGGAGACGAGATCAAGCAGATCAACGGTCGTCAAGAGACCTACGAGACTGAG
GAATCCGCTCTTGGCTCCACGCGACTATATATTTGTCTCTAATTGTACTTTGACATGCTCCTCTTCTTTACTCTGA
TAGCTTGACTATGAAAATTCCGTCACCAGCCCCTGGGTTCGCAAAGATAATTGCACTGTTTCTTCCTTGAACTCT
CAAGCCTACAGGACACACATTCATCGTAGGTATAAACCTCGAAAATCATTCCTACTAAGATGGGTATACAATAG
TAACCATGGTTGCCTAGTGAATGCTCCGTAACACCCAATACGCCGGCCGAAACTTTTTTACAACTCTCCTATGA
GTCGTTTACCCAGAATGCACAGGTACACTTGTTTAGAGGTAATCCAAGCTTGGCGTAATCATGGTCATAGCTGT
TTCCTGTGTGAAATTGTTATCCGCTCACAATTCCACACAACATACGAGCCGGAAGCATAAAGTGTAAAGCCTGG
GGTGCCTAATGAGTGAGCTAACTCACATTAATTGCGTTGCGCTCACTGCCCGCTTTCCAGTCGGGAAACCTGTC
GTGCCAGCTGCATTAATGAATCGGCCAACGCGCGGGGAGAGGCGGTTTGCGTATTGGGCGCTCTTCCGCTTCC
TCGCTCACTGACTCGCTGCGCTCGGTCGTTCGGCTGCGGCGAGCGGTATCAGCTCACTCAAAGGCGGTAATAC
GGTTATCCACAGAATCAGGGGATAACGCAGGAAAGAACATGTGAGCAAAAGGCCAGCAAAAGGCCAGGAAC
CGTAAAAAGGCCGCGTTGCTGGCGTTTTTCCATAGGCTCCGCCCCCTGACGAGCATCACAAAAATCGACGCTC
AAGTCAGAGGTGGCGAAACCCGACAGGACTATAAAGATACCAGGCGTTTCCCCCTGGAAGCTCCCTCGTGCGC
TCTCCTGTTCCGACCCTGCCGCTTACCGGATACCTGTCCGCCTTTCTCCCTTCGGGAAGCGTGGCGCTTTCTCAA
TGCTCACGCTGTAGGTATCTCAGTTCGGTGTAGGTCGTTCGCTCCAAGCTGGGCTGTGTGCACGAACCCCCCGT
TCAGCCCGACCGCTGCGCCTTATCCGGTAACTATCGTCTTGAGTCCAACCCGGTAAGACACGACTTATCGCCAC
TGGCAGCAGCCACTGGTAACAGGATTAGCAGAGCGAGGTATGTAGGCGGTGCTACAGAGTTCTTGAAGTGGT
GGCCTAACTACGGCTACACTAGAAGGACAGTATTTGGTATCTGCGCTCTGCTGAAGCCAGTTACCTTCGGAAA
AAGAGTTGGTAGCTCTTGATCCGGCAAACAAACCACCGCTGGTAGCGGTGGTTTTTTTGTTTGCAAGCAGCAG
ATTACGCGCAGAAAAAAAGGATCTCAAGAAGATCCTTTGATCTTTTCTACGGGGTCTGACGCTCAGTGGAACG
AAAACTCACGTTAAGGGATTTTGGTCATGAGATTATCAAAAAGGATCTTCACCTAGATCCTTTTAAATTAAAAA
TGAAGTTTTAAATCAATCTAAAGTATATATGAGTAAACTTGGTCTGACAGTTACCAATGCTTAATCAGTGAGGC
ACCTATCTCAGCGATCTGTCTATTTCGTTCATCCATAGTTGCCTGACTCCCCGTCGTGTAGATAACTACGATACG
GGAGGGCTTACCATCTGGCCCCAGTGCTGCAATGATACCGCGAGACCCACGCTCACCGGCTCCAGATTTATCA
GCAATAAACCAGCCAGCCGGAAGGGCCGAGCGCAGAAGTGGTCCTGCAACTTTATCCGCCTCCATCCAGTCTA
TTAATTGTTGCCGGGAAGCTAGAGTAAGTAGTTCGCCAGTTAATAGTTTGCGCAACGTTGTTGCCATTGCTACA
GGCATCGTGGTGTCACGCTCGTCGTTTGGTATGGCTTCATTCAGCTCCGGTTCCCAACGATCAAGGCGAGTTAC
ATGATCCCCCATGTTGTGCAAAAAAGCGGTTAGCTCCTTCGGTCCTCCGATCGTTGTCAGAAGTAAGTTGGCCG
CAGTGTTATCACTCATGGTTATGGCAGCACTGCATAATTCTCTTACTGTCATGCCATCCGTAAGATGCTTTTCTG
TGACTGGTGAGTACTCAACCAAGTCATTCTGAGAATAGTGTATGCGGCGACCGAGTTGCTCTTGCCCGGCGTC
AATACGGGATAATACCGCGCCACATAGCAGAACTTTAAAAGTGCTCATCATTGGAAAACGTTCTTCGGGGCGA
AAACTCTCAAGGATCTTACCGCTGTTGAGATCCAGTTCGATGTAACCCACTCGTGCACCCAACTGATCTTCAGC
ATCTTTTACTTTCACCAGCGTTTCTGGGTGAGCAAAAACAGGAAGGCAAAATGCCGCAAAAAAGGGAATAAGG
GCGACACGGAAATGTTGAATACTCATACTCTTCCTTTTTCAATATTATTGAAGCATTTATCAGGGTTATTGTCTC
ATGAGCGGATACATATTTGAATGTATTTAGAAAAATAAACAAATAGGGGTTCCGCGCACATTTCCCCGAAAAG

Figure 8A (Continued)

TGCCACCTGACGTCTAAGAAACCATTATTATCATGACATTAACCTATAAAAATAGGCGTATCACGAGGCCCTTT
CGTC

Annotation:      Ankyrin repeat protein
Number of exons: 2
                 promoter    1      989
Position of      exon 1      990    1035
elements         exon 2      1204   3107
                 terminator  3108   3848
```

TAAAACGACGGCCAGTGAATTCCGCCAGGTTGATCTTGTTCTACAGAGGCCAGCGACTCAGCATAATTGCTTGT
TCGAGCGGATTAGACAGATCAGTGCAGCCCTCGTCAGGCACAAGGCACGAGTCGAAGATATGCCCCAACCCG
CAGCTCCAGCGCCCGTACCCAAGTCTTGTTGCCTTTGTGCCACATTCTGTACCCAGCTGCCTAAGACGTAGCATT
GGACATGTGATGCAGATGTATTTGTAGGGGGTATCGGGAAGTGCCCGTGTGCTTCGCGATGAGATTCCGCAG
ATTTACACCCTGAACCGCTACCCTACAATACCTTACATCTTACAAGTCTACAAGGGTAAAATACGTCGGCATGT
GCGAGTACCAAACCACAATATGCCAACTTCCGCTATCTACTCACCTTTGATATATTCCCCACGTACAATTATTCT
GCCTTTTCGTTGGGTTACCGCTACTGGTCCTCGGCTGATACATGAAGGCGGATTATCATCCTGGTGTTGTGGAT
CAGCTGCAATCGAATGGGCTCTACGCAATCATATGAGGAAACATCAGCATAAACAATAATATGCTAAACGTCA
GATTAGAGAAAAGCAATGAGTAGAATGACAACCTGACGAGAGTTCACGTTGTGAACAAGCCTCGAGGCTGTT
CAAGGCTCGGACCCAACAGGGAATACTTACTACTAGGTATGGAGATCAAGCCTCGTAAAGCCGGGTTATGACT
CTGTTCAGCACCTTATCTTAGTGGGGTGGTCGCCGGTTGACTCAACATCATTCCAGCCTCGTCATAGAGGGGCA
ACTCTTCAGCCTTTTCTACCACCGCAACTCCCCTCTTGCTCGCGACAAATACCTTGGTCGCACAGCTCTTTGCTGT
TCACGCGTCTTTCTTTTGCTTCGACAGTTTAAATACAGAAGCCGCCTTGCTTGCCGTAGGATTCAACGACGCTCC
ATACCCGCAGCCTCCCCGGGACTTGACACAATGGCTCAGAACCCGGCAGACGAGCTCCTTCGGCGTCCGTTAT
ATGGTAAGTAAAAGCACTTTGTCGCGCCACTGGCAAGGCCTACCAATACCGGCCGAGACACGGGACACGAGA
CATACAGCTTATAGGACACGCGCTGTTTCTTGCCCGAGTCTCGATTCGATTCTACGATCTCTGAACAAGTGCTG
ACAACTTGCGCCAACGCGGTCTTAGTCTACGATCTTCCACCAGAAAGCCTCGCAGGCTTGACGCTGAAACCGG
ACGCAGACGCCATCGCCATCGAGGAACCCGAGACGTCAACGACTCCCAGCCAGGCTTCGGACTCGTCCTCCGA
CAGCTTTGTCGGTTCCAAGCATGCTCTCTCTGCAAGCTTTCCTTCACCACCGTAATAGACCAGCGAAGTCACAT
CAAGTCCGATTTCCACAACTACAATCTCAAGCAGAAGCTGCGGGGTCAGGGCCCGGTCTCAGAGACCGAGTTC
GAAAAGCTGATTGAGACTCTGGACGAATCGCTCTCGGGCTCCGACTCGGAAGATTCGGAAGACGACGAGGAC
GAAGGGCGTCAGGATTCTACGCTTACGGCGCTGCTTAAGAAGCAAGCAAAGCTGACGGAGAGACGAAACGCC
ACCAGAGAGAATAACAAACAAGGCGATAATGACGACGATGAACTCTCAGGAAGGCCAGGCAAGGGGAAGCC
GGCGCTGATATGGTTCAGCTCGCCGTTGCTTCCAGAAAACACGTATTTCGGCATCTACCGAGCGATATTTACAG
ATGAAGAGCAACGCCAGCCCGACTTGGTCGAGGTCATCCGGAAGAAGCAGCTCGAGCCCATAGCCATGCCTA
AGCCTGCAAAAGACGGGACGCTGCCGCCGATCGCGTACAAGGGGCCGCACTTCTTCCTCTGCATGATCGGAG
GCGGCCATTTTGCCGCCATGGTCGTCTCCCTCGCGCCGAGAGCCGCCAAATCGGGCAGCACAACCATGAACCG
AGAGGCCACGGTCCTCGCCCACAAGACCTTTCACAGATACACGACGCGTCGAAAACAGGGTGGTTCTCAGTCG
GCGAACGACAACGCCAAAGGCAAAGCGCACTCTGTCGGCTCGTCTCTGCGTCGGTACAACGAAACCGCCCTG

Figure 8B (Continued)

```
GTCGAGGATGTGCGCGCTCTTCTCCAGGACTGGAAGGGGCTCTTGGACTCTTCCGAACTGCTTTTCATCAGGG
CAACAGGAACGACAAATAGGAGAACCCTGTTCGGCCCCTATGAAGGACAAGTTCTTCAAGCCAACGACGCTCG
TATCCGAGGGTTTCCATTTAGTACCAGGAGAGCTACTCAGAACGAGCTGATGCGGTCCTTCATCGAGCTAACTC
GACTCAAAGTCAGGGAGATTGCTCCAAGCAAGGCAGGACTAGACAAGGCGAACGCGGCACCAAGCAAACCT
GCGACACCATCCAAGCCGGCAAAGCCGACGTTGTCAGAAGAGGAGGAAACGGCGCTGCTTCATACGTCTCAG
CTACAAGCCTTTGTACGGCGGTCCAAGCTACCTGCACTTTTATCGTACCTCACAAAAAATAACCTGGATCCGGA
CTTTGAGTTCTATCCTCCGGAACAAAACTACCATACACCACGCCTTTTACACTACGCAGCTGCTCAGAACTCTGC
TCCTTTGGTGCTGGGGATCCTTACACGAGCCGGGGCGAACCCGTTGCTCAAGAACGCGGAGGGAAAGACGCC
CTTCGAGCTCGCTGGAGATCGCTCTACGCGGGATGCCTTTAGAGTAGCCCGCTCTGAAGTAGGAGAGGGGAA
ATGGGACTGGGATGCGGCCAAGGTTCCTCCCGCCATGACCAAGGACGAGGCAGATCGCCGTGACGAGCGGG
AAAAGCAAGAAGCAGATAAGAAGGAGTCCGACAGGAGAAAAGCGGAAGAAGAGAGGCTCCGTACTGAAGG
GCCAAGGCTCCCTGAGCAGAAGACGAAGAAGGGAAACAGCATAGCGTCCATAATCGCCAAGACGCCACAAGA
GCGCAGGGAGGAGGAAGCCAGGGGGCTGACGCCCGAGATGAAGTTGAAACTGGAACGAGAAAGACGAGCG
CGAGCGGCAGAAGAGAGAATCAAGAGGCTACAGGGTGGTAGTTGAATATATGCTTCCTGTGAGACAGCTAAG
CCACGTAGTAGACGTAGGTAGGTAGGTAGGTAGCTCATGCTGGCATCAATATCGATCTATCTGACCTTGAAAT
CACCTTTGGCTAGGTTGCCAGCCGTTCACTTATGATTCCTAGGACGAAATACCCATCAAGCAACTGAACAACAC
AGCAGTTGTATCTATTCAGAACCTTTCTTGCCGTAGCACCACACGTGAAATGCTCAGCGCGTGTCCTCGACTGG
CCTACAACAGAGGAGGCACTCCCAAGATATGCGTACATAGTCCACGTCTAGCCCGAGTTGAAATCAAACATAT
GCCATACAGGCCTTCGTGCATCTTTTGGATGAACACCAACAGCATCACCATCATGCACAACGCCCTGGTAGGGC
ATAAAAGGGGGGAATATGCCCAAGTGCTCTTTCTTCTTCTTGAATGCGAAAGTTCTTCACGAGAACACGGAA
GTCTCATCCAGCACGCGGATGCACCAAGCATCTTCGCTTAAGACGCTCCCATGAACGGGTGGCAGTCACGACG
GGCAAGTGGTCCGATGCCGAAGAGTGGCAGCTGCAAGAGCGCCTGAACCACTGCCGAGGGTTTCCACTCCCA
CACTCCCACACTCCCACAAATTGCTCTCCTGGAAACGACATGTTCTCCCACAAACATTTCTTCCTTCACGATACCC
AACATTTCTCTCATTCCAGCCTACACTTCGATCTAGACGGCTTTGATTTCCT
```

GENES/GENETIC ELEMENTS ASSOCIATED WITH MATING IMPAIRMENT IN *TRICHODERMA REESEI* QM6A AND ITS DERIVATIVES AND PROCESS FOR THEIR IDENTIFICATION

CROSS-REFERENCE TO RELATED APPLICATIONS

This application is a national Phase application filed under 35 USC 371 of PCT International Application No. PCT/EP2013/077910 with an International Filing Date of Dec. 23, 2013, which claims under 35 USC 119(a) the benefit of European Application No. 12199606.0, filed Dec. 28, 2012 and U.S. Application No. 61/746,861, filed Dec. 28, 2012, the entire contents of which are incorporated herein by reference.

FIELD OF THE INVENTION

The present invention relates to genes/genetic elements associated with mating impairment of strain *Trichoderma reesei* QM6a or strains derived thereof. The invention further relates to a process for identifying genes/genetic elements associated with mating impairment in *Trichoderma reesei* QM6a and strains derived thereof. Said process enables a rapid and efficient identification of genes/genetic elements associated with mating impairment. Consequently, the present invention relates towards an approach to advance tools for manipulating *Trichoderma reesei* towards improved and facilitated strain breeding so as to be able to improve industrial producer strains by classical genetic means. This will not only add a further tool in strain breeding and maintenance, but also allow for the introduction of genetic traits from other strains of *Trichoderma reesei* (*Hypocrea jecorina*), or the cleaning of strains from non-desirable mutations of genes and/or undesired genes, e.g. genes conferring resistance to antibiotics, marker genes, genes for secondary metabolism, pigment formation, undesired enzymes etc.

BACKGROUND OF THE INVENTION

Filamentous fungi are capable of producing high amounts of extracellular proteins. Yet, the production level of any protein of interest in naturally occurring strains is usually too low for commercial exploitation, rendering substantial strain improvement programs essential (Punt 2002). In industrial filamentous fungi, this is traditionally done by classical mutagenesis, and/or targeted gene manipulation in combination with protein engineering. Basically, this approach consists of subjecting the fungus to sub-lethal doses of mutagens (frequently used: for example irradiation by UV light or ionizing radiation, addition of chemical mutagens like nitrosomethyl guanidine, ethylmethansulfonat or ethidium bromide) and subsequent screening of the survivors for improved production of the desired product. Obviously, this approach is only as good as the selection method.

*Trichoderma reesei* (teleomorph *Hypocrea jecorina*) is a workhorse organism for the industrial production of enzymes. Using random mutagenesis, academic and industrial research programs have, over several decades, produced strains of *T. reesei* whose enzyme productivity is several times higher than that of the "original" *T. reesei* strain QM6a that was isolated from US Army tent canvas in 1944 in the Solomon Islands (LeCrom et al. 2009).

A major constraint using random mutagenesis for strain improvement, however, results from the fact that, by definition it cannot be directed to act on distinct target genes. Mutations may thus not only be beneficial and improve or disrupt target genes but can affect other genes as well leading to unwanted collateral damage causing restrictions in e.g. strain stability, reduced growth rates or auxotrophy for amino acids and/or vitamins. While recombinant techniques overcome these problems by introducing targeting focus, they may be unsuitable for complex genetic traits that are caused by unknown or multiple genes or large genomic fragments.

Seidl et al. (2009) were the first to describe the ability of *Trichoderma reesei* to perform sexual reproduction. Taxonomically *T. reesei* (and its teleomorph *H. jecorina*) belong to the group of Ascomycetes (class of Sordariomycetes) and within this group to those fungi which are heterothallic. Heterothallism means that the two mating type loci MAT1-1 and MAT1-2 which are necessary for successful sexual reproduction occur in different strains and self-fertilization is not possible.

During the process of sexual reproduction *T. reesei* produces perithecia that are initiated by coiled or variously distinctive structures containing the ascogonium. The ascogonium is the cell that will receive a nucleus during mating and go on to produce the dikaryotic hyphal system. One of the cells within the coil functions as the ascogonium and the rest either remains inactive or gives rise to hyphae that branch and proliferate to surround the entire structure. In many cases neighboring hyphae also engage to envelope the coil. These surrounding hyphae eventually consolidate to form the walls or peridium of the perithecium (http://website.nbm-mnb.ca/mycologywebpages/NaturalHistoryOfFungi/SordariomycetesDiscussion.html) (FIG. 3).

The formation of perithecia in *T. reesei* occurs ascohymenial meaning that the ascocarp formation initiates with the fertilization of the ascogonium. The primordium subsequently differentiates into a true hymenium directly from the generative, ascogeneous hyphae. The ascohymenial development thus begins with fertilization and differentiation of generative hyphae, followed by the development of the ascocarp. Stromata (fruiting bodies) are therefore formed by the partner acting as a female during sexual reproduction.

Since all strains of *T. reesei* which are nowadays used in industry can be traced back to strain QM6a they all carry—as does strain QM6a—the MAT1-2 locus. Crossing of different industrial strains with each other to further improve them by introducing favorable traits or to rid strains from mutations of genes or undesired genes such as e.g. genes conferring e.g. resistance to antibiotics, coding undesired products whose presence may interfere with regulatory requirements is therefore not possible at present.

A possibility to overcome the inability to cross different *T. reesei* mutant strains would be to exchange the mating type locus by the opposite one at the same genomic locus. In case of *T. reesei* QM6a this implies to exchange the MAT1-2 locus for the MAT1-1 locus.

Kang et al. (1994) have shown that strains of *Magnaporthe grisea* in which the MAT locus was exchanged were fertile in crossings with strains of the opposite mating type (i.e.: strains in which the MAT1-2 locus was replaced by the MAT1-1 locus were fertile in crossings with the original MAT1-2 carrying strain). A successful exchange of the mating type locus was also described for *Neurospora crassa* (Chang, 1994).

WO 2011/095374 relates to the use of mating type switching to improve the sexual behavior of filamentous fungal strains. Disclosed is the identification of mating types of *Aspergillus niger* and *Aspergillus tubigensis* so as to transform *Aspergillus niger* into a heterothallic fungus, i.e. filamentous fungus individuals having opposite mating types resulting in one or more pair of strains with two opposite mating types.

Seidl et al. (2009) introduced the complementary mating type locus (MAT1-1) ectopically into *T. reesei* strain QM6a thereby generating a strain carrying both mating type loci (MAT1-1 and MAT1-2). This strain was fertile in crossings with wild type strains of the *T. reesei* teleomorph *H. jecorina* carrying either the MAT1-1 or the MAT1-2 locus. However, in crossings with strain QM6a and its derivatives (all MAT1-2) this strain was found to be sterile.

From these results—that a QM6a strain carrying both mating types is able to form fruiting bodies with MAT1-1 and MAT1-2 strains of *H. jecorina*, but not with QM6a—it is concluded that *T. reesei* QM6a is able to act as a male partner but that it cannot produce fruiting bodies and is therefore female sterile. Probably its maintenance in the labs for over 60 years without selective pressure acting to maintain mating competence has resulted in mutations in one or more of the genes necessary for sexual recombination.

Hence, there is a need in the prior art for a method that allows the rapid and efficient identification of genes associated with said mating impairment of a *Trichoderma reesei* QM6a strain. So far, the genes associated with mating impairment in the genome of *Trichoderma reesei* QM6a have neither been identified nor been characterized. The reason for this is mainly due to the fact that classical genetic approaches using sexual crossings have not been established for *Trichoderma reesei* QM6a due to its self-sterility. It is, moreover, not known which genes contribute to or account for the self-sterility of QM6a. So far, it is completely unknown which of the 9143 annotated genes in the genome of QM6a (34.1 Mbp) is associated with its self-sterility. The genome of *T. reesei* QM6a has been published in Martinez et al. (2008). The *T. reesei* nucleotide sequence and annotation data have been deposited in GenBank under accession number AAIL 00000000.

The present inventors have recently topically replaced the MAT1-2 locus of QM6a with the opposite mating type (MAT1-1) at the same genomic location, but crossings of the resulting MAT1-1 strains with *T. reesei* QM6a derived MAT1-2 strains were not successful demonstrating self-sterility.

It is, therefore, an object of the invention to identify and provide genes/genetic elements associated with the mating impairment in strains of *T. reesei* QM6a and its derivatives.

It is further an object of the invention to provide a process for the rapid and efficient identification of genes associated with mating impairment in *T. reesei* QM6a. It is a further object of the invention to provide a process for restoring the mating competence of *Trichoderma reesei* QM6a and its derivatives. It is a further object of the invention to provide a mating competent form of *T. reesei* QM6a and its derivatives. It is a further object of the invention to provide a process to sexually recombine genetic information of *Trichoderma reesei* QM6a and its derivatives. Another object of the invention is to prepare a strain of *Trichoderma reesei* QM6a or of a derivative thereof having a sexual cycle.

The inventors have surprisingly found that the mating impairment of a *Trichoderma reesei* strain QM6a or a strain derived thereof is caused by defined genes/genetic elements and mutations in defined genes/genetic elements of said organism and may be corrected by correcting or eliminating said mutations, i.e. by replacing the corresponding gene(s)/genetic element(s) with a functional counterpart or by inserting the gene/genetic element that is completely or partially missing. A functional counterpart of said gene(s)/genetic element(s) is a gene or genetic element that restores the mating ability of *Trichoderma reesei* QM6a. Said capability is conferred to said gene/genetic element by correcting the mutations as depicted in Table 3 to such an extent that the gene or genetic element performs its function in the mating process. Preferably all mutations of the respective gene/genetic element are corrected.

It has further been found that for a *Trichoderma reesei* QM6a strain or any derivative thereof the technique of backcrossing may advantageously be used for identifying the genes or genetic elements that are associated with mating impairment in *Trichoderma reesei* QM6a or any derivative thereof (female sterility genes). Moreover, it has been found that mutations in certain genes are associated with mating impairment in *Trichoderma reesei* QM6a. The mutation may be a simple point mutation, an insertion or a deletion, whereby the deletion may be a deletion within an existing gene or a full or partial deletion of a gene/genetic element per se.

The above genes or genetic elements/genetic information may be contributory to mating impairment or may cause—singly or in combination—mating impairment in *Trichoderma reesei* QM6a. Hence, said genes/genetic elements/genetic information may be directly or indirectly associated with the mating impairment of said organism.

Genes or genetic elements/genetic information directly associated with the mating impairment of *Trichoderma reesei* QM6a and its derivatives are generally genes of which the full or partial lack of functioning leads to a reduced or complete lack of formation of fruiting bodies when crossed with a corresponding organism. The term "mating impairment" is to relate to all degrees of an impaired or reduced mating ability. A reduced mating ability can thus also be seen in a substantially prolonged time until mature fruiting bodies with viable ascospores become visible. Corresponding genes and/or genetic elements have a direct impact on any organ or metabolic mechanism that has a direct impact on the mating ability of *Trichoderma reesei* QM6a and its derivatives, such as for example genes coding for pheromone receptors or genes coding for organs needed for successful mating. A genetic element comprises genetic information that is not translated into a protein but is directly or indirectly related to the mating behaviour of *Trichoderma reesei* QM6a or its derivative. Said genetic information may be necessary for the control or regulation of the expression of a protein. A genetic element may be a promoter, an enhancer, an activator, a regulator or an expression control sequence.

Genes/genetic elements indirectly associated with the mating impairment of *Trichoderma reesei* QM6a and its derivatives are genes which are not directly associated with the mating impairment of said organism but which relate to morphological structures or metabolic mechanisms that have an indirect impact on the ability of *Trichoderma reesei* QM6a and its derivatives to mate with a corresponding organism. Mutations in genes for example related to hyphal cell wall structure or hyphal branching could have an indirect impact on the mating ability of *Trichoderma reesei* QM6a and its derivatives. The function of said genes may be executed by proteins encoded by said genes. Said gene/genetic element may also be necessary for expression or regulation of a corresponding protein (p. ex. promoter, enhancer, activator, regulator, initiator, expression control sequence).

SUMMARY OF THE INVENTION

The invention, therefore, relates to a process for identifying a gene/genetic element associated with mating impairment in strains of *Trichoderma reesei* QM6a or strains derived thereof comprising the steps of
a) providing a first strain being a *Trichoderma reesei* QM6a strain having a MAT1-2 locus or a strain derived thereof,
b) sexually crossing said strain with a second strain being a mating competent strain of a *Trichoderma reesei* (*Hypocrea jecorina*) strain having a complementary MAT1-1 locus,
c) repeatedly back-crossing the MAT1-1 progenies from the crossing of b) or the back-crossing thereof with the first strain of a), until a strain is obtained that is substantially identical to the first *Trichoderma reesei* QM6a strain or a strain derived thereof, but carries the MAT1-1 locus and is mating competent for crossing with *Trichoderma reesei* QM6a or any of its MAT1-2 progeny,
d) selecting the progeny from step c) that is mating competent for crossing with a *Trichoderma reesei* (*Hypocrea jecorina*) having a MAT1-2 locus, and
e) identifying the gene(s)/genetic element(s) associated with mating impairment by comparing the genome of the progenies selected in step d) with the genome sequences of the first strain of a) whereby said gene(s)/genetic element(s) may be fully or partially missing or existing in a mutated or in a form having deletions and/or insertions in the first strain thus being a gene or a genetic element directly or indirectly associated with mating impairment in strains of *Trichoderma reesei* QM6a or a strain derived thereof.

The invention further relates to a process as outlined above further comprising the step of inserting the functional gene(s) and/or genetic element(s) of the mating competent strain corresponding to the gene(s)/genetic element(s) associated with mating impairment identified according to the above feature e) into a *Trichoderma reesei* QM6a having a MAT1-1 locus or a strain derived thereof and crossing said strain with a *Trichoderma reesei* QM6a having a MAT1-2 locus or a strain derived thereof, whereby the formation of fruiting bodies by *Trichoderma reesei* QM6a having a MAT1-1 locus and having inserted a gene(s) and/or genetic element(s) identified as above or a strain derived thereof is indicative of a direct association of said gene(s)/genetic element(s) with said mating impairment.

The invention further relates to a process for identifying a mating competent phenotype associated with a functional gene and/or genetic element corresponding to the gene/genetic element associated with mating impairment identified according to the above feature e) comprising the steps of a) providing a mating competent *Trichoderma reesei* QM6a MAT 1-1 strain, b) rendering the above functional gene or genetic element non-functional and c) measuring the mating capability of said *Trichoderma reesei* QM6a MAT 1-1 strain, wherein a positive mating capability of said *Trichoderma reesei* QM6a MAT 1-1 strain is indicative of said gene or genetic element being non-essential for a mating competent phenotype and wherein a negative mating capability of said *Trichoderma reesei* QM6a MAT 1-1 strain is indicative of said gene or genetic element being essential for a mating competent phenotype.

The invention further relates to a process for restoring the self-mating competence of a *Trichoderma reesei* QM6a strain that is not mating competent or a strain derived thereof, wherein one or more mutated or fully or partially missing gene(s) associated with mating impairment is/are replaced by or complemented with the corresponding functional gene(s). The invention also relates to the self-mating competent strain of *Trichoderma reesei* QM6a or a derivative thereof obtained or obtainable by said process.

The invention, moreover, relates to a fungal strain of the genus *Trichoderma* (*Hypocrea*) suitable for use in the industrial production of a product of interest, whereby the strain is a *Trichoderma reesei* QM6a and its derivative strains, wherein the mating competence has been corrected as above and which has been transformed with a target gene and/or a gene encoding a product of interest.

Moreover, the invention relates to the gene(s)/genetic element(s) associated with mating impairment in strains of *Trichoderma reesei* QM6a obtained by the above process which have a sequence of SEQ ID NOs: 8 to 155 and SEQ ID NOs:163 to 174 of the enclosed sequence listing as well as to sequences related to said sequences due to the degeneracy of the genetic code, homology and/or identity as long as the same function is performed.

The invention also relates to the corresponding genes of the wild-type organism *Hypocrea jecorina* which are functional genes in terms of mating competence and which are suitable to restore female fertility of *Trichoderma reesei* QM6a.

Specifically the invention relates to the functional counterparts of SEQ ID NOs: 8 to 155 and SEQ ID NOs: 163 to 174, i.e. the sequences of SEQ ID NOs: 8 to 155 wherein at least one and preferably all of the mutations listed in Table 3 have been corrected. The invention moreover relates to variants and mutants of said corrected genes and to variants and mutants of the missing genes of SEQ ID NOs: 163 to 174 as long as the mating capability is maintained. Variants and mutants may comprise silent and non-silent mutations, insertions, deletions or sequence additions. The mutations are preferably conservative mutations.

The invention also relates to the functional counterparts of said genes of *Hypocrea jecorina* with the proviso that said genes still have the ability to restore female fertility of *Trichoderma reesei* QM6a. Said functional counterparts may be genes in which only the sterility-conferring mutations were corrected.

The invention particularly relates to the functional counterparts of the genes having SEQ ID NO: 40, SEQ ID NO: 110, SEQ ID NO: 112 and SEQ ID NO: 134, i.e. SEQ ID NO: 216, SEQ ID NO: 218, SEQ ID NO: 220 and SEQ ID NO: 222 or a functionally equivalent sequence derived therefrom.

DESCRIPTION OF THE INVENTION

The sequences of said gene(s) and the putatively encoded proteins per se were known and have been published in Martinez et al. (2008), but the function with respect to mating impairment of none of them has so far been verified. Moreover, the sequence of said genes may be retrieved from the NCBI data base under the accession number as specified in the sequence listing and the further link to the corresponding gene. SEQ ID NOs: 26, 72, 82, 84, 94, 96, 100, 70, 106, 120, 130, 140 and 154 have been newly annotated. Moreover, it has not been known that mutations in said genes are associated with the mating impairment and specifically with female sterility in said organisms. From said database, however, it is not evident that said sequences are mutated sequences in *Trichoderma reesei* QM6a or strains derived thereof thus being associated with a partial or full loss of mating competence in said organism and how to replace that gene by a functional one.

It has, however, not been known that the identified genes are associated with mating impairment in *Trichoderma reesei* QM6a. It has further been found that due to mutations, insertions or deletions said genes are associated with the mating impairment of *Trichoderma reesei* QM6a. Replacing said genes by the non-mutated and/or complete form will correct the mating inability of *Trichoderma reesei* QM6a, thus, allowing for the production of industrially important strains of QM6a by sexual crossing. Hence, the inventors have found genes which correct the inability of *T. reesei* QM6a MAT1-1 to mate with *T. reesei* QM6a MAT1-2. The inventors have been able to locate genes in *Trichoderma reesei* QM6a which in their presently existing form, which is considered to be a mutated form, are associated with mating impairment of said organism. The inventors have further found that *Trichoderma reesei* QM6a lacks several genes the presence of which is associated with mating competence and the full or partial loss of which is associated with mating impairment. Said mating impairment relates to any form of full or partial loss of the ability of *Trichoderma reesei* QM6a to mate with a *T. reesei* MAT1-1 organism and, particularly, relates to the female sterility of said organism. Hence, said genes may also be considered as genes associated with female sterility in strains of *Trichoderma reesei* QM6a. By comparing said gene(s) with the corresponding gene(s) of the final mating competent progeny of the above process the corresponding functional genes could be retrieved. Said comparison reveals which gene deviation or lack of gene is associated with the observed mating impairment of said organism. Hence, the gene associated with mating competence, in particular female mating competence, may be used as a template for amending the corresponding gene of *T. reesei* QM6a, which is associated with mating impairment and female sterility, respectively.

The term "mating impairment" is to relate to any form of impaired ability of *Trichoderma reesei* QM6a and its derivatives to mate with a corresponding organism. The mating impairment may be a full or a partial mating impairment of *Trichoderma reesei* QM6a and its derivatives. Preferably, the mating impairment relates to the female sterility of *Trichoderma reesei* QM6a or strains derived thereof. Mating impairment may relate to defects in any part or structure of the sexual cycle of ascomycetes as depicted in FIG. 3, for example fertilization, spermatogenesis or sex determination.

The above identified genes and/or genetic elements are directly or indirectly associated with mating impairment in strains of *Trichoderma reesei* QM6a or in strains derived thereof. This means that said genes and/or genetic elements may be contributory or causative for the respective type of mating impairment. The same holds for the mutations, insertions or deletions in the mutated form of the genes. Said deviations from the functional form may either be causative or contributory to mating impairment.

Hence, the present invention relates to the genes/genetic elements of SEQ ID NOs: 8 to 155 and SEQ ID NOs: 163 to 174 that have been identified to be associated with mating impairment in strains of *Trichoderma reesei* QM6a. The sequences of SEQ ID NOs: 8 to 155 of the sequence listing are considered as mutated sequences and the changes, insertions and/or deletions of said sequences as indicated in Table 3 correlate with an improved mating competence.

The present invention further relates to the genes/genetic elements of SEQ ID NOS: 163 to 174 which only exist in *Hypocrea jecorina* and which have no counterpart in *Trichoderma reesei* QM6a. Said sequences as well as their contribution to the mating impairment of *Trichoderma reesei* QM6a were not known before. A further functional connotation according to the present invention in relation to said gene sequences is given in Table 4.

The above genes may be corrected or replaced singly or in combination by the corresponding functional gene(s) to restore the full mating competence of *Trichoderma reesei* QM6a. The corresponding fully functional counterparts exist in the wild-type *Hypocrea jecorina* MAT 1-1 and are known from the comparison of the sequences of the identified genes and/or genetic elements of *Trichoderma reesei* QM6a MAT 1-2 with the sequences of the corresponding genes and/or genetic elements of *Trichoderma reesei* CBS1/A8_02, MAT 1-1, *Trichoderma reesei* CBS2/A8-11 or the wild-type *Hypocrea jecorina* MAT 1-1 respectively. The sequences are provided by sequencing the genes by methods known per se. The genes missing in *Trichoderma reesei* QM6a according to SEQ ID NOs: 163 to 174 may be inserted singly or in combination to restore the mating competence of *Trichoderma reesei* QM6a. The insertion of said gene(s) may be combined with the above correction of mutations, insertions or deletions.

Preferably, the following genes are replaced/complemented with the corresponding non-mutated/complete gene: SEQ ID NO: 16, SEQ ID NO: 50, SEQ ID NO: 70, SEQ ID NO: 86, SEQ ID NO: 94, SEQ ID NO: 96, SEQ ID NO: 106, SEQ ID NO: 120, SEQ ID NO: 128, SEQ ID NO: 163, SEQ ID NO: 165, SEQ ID NO: 169, SEQ ID NO: 171. A further preferred group for genes to be corrected/complemented are SEQ ID NO: 8, SEQ ID NO: 11, SEQ ID NO: 12, SEQ ID NO: 132, SEQ ID NO: 134, SEQ ID NO: 150, SEQ ID NO: 152, SEQ ID NO: 18, SEQ ID NO: 14, SEQ ID NO: 126, SEQ ID NO: 130, SEQ ID NO: 154, SEQ ID NO: 167, SEQ ID NO: 168, SEQ ID NO: 173 and SEQ ID NO: 174.

More preferably, the following genes are replaced/complemented with the corresponding non-mutated/complete gene: SEQ ID NO: 36, SEQ ID NO: 40, SEQ ID NO: 56, SEQ ID NO: 58, SEQ ID NO: 60, SEQ ID NO: 66, SEQ ID NO: 68, SEQ ID NO: 72, SEQ ID NO: 82, SEQ ID NO: 92, SEQ ID NO: 100, SEQ ID NO: 110, SEQ ID NO: 112, SEQ ID NO: 118, SEQ ID NO: 120, SEQ ID NO: 122, SEQ ID NO: 124, SEQ ID NO: 134, SEQ ID NO: 138, SEQ ID NO: 144, SEQ ID NO: 146, SEQ ID NO: 148 and SEQ ID NO: 152.

Most preferably, the following genes are replaced/complemented with the corresponding non-mutated/complete gene: SEQ ID NO: 40, SEQ ID NO: 110, SEQ ID NO: 112 and SEQ ID NO: 134.

Further preferred sequences associated with mating competence are SEQ ID NO: 224, SEQ ID NO: 226, SEQ ID NO: 228 or SEQ ID NO: 230.

The invention particularly relates to the following genes essential for mating competence in *Trichoderma reesei* QM6a or strains derived therefrom: SEQ ID NO: 216, SEQ ID NO: 218, SEQ ID NO: 220 and SEQ ID NO: 222.

The invention also relates to functionally equivalent sequences of said sequences, for example, sequences related due to the degeneracy of the genetic code or sequences having a degree of homology to said sequences, for example 80%, preferably 90%, more preferably 95% or 98%.

The invention further relates to the polypeptides encoded by the corrected genes/genetic elements identified as associated with mating impairment in strains of *Trichoderma reesei* QM6a or strains derived therefrom.

Specifically the invention relates to the polypeptides encoded by nucleotides 888 to 2790 of SEQ ID NO: 220, nucleotides 1263 to 2726 of SEQ ID NO: 218, nucleotides 990 to 3107 of SEQ ID NO: 222 or nucleotides 919 to 6039 of SEQ ID NO: 216. Said polypeptides are associated with mating competence and correspond to SEQ ID NOs: 221, 219, 223 and 217. The invention also relates to polypeptides associated with mating competence and having a degree of sequence identity of at least 80%, preferably at least 90%, more preferably at least 95%, even more preferably at least 98% with the coding sequence of SEQ ID NO: 220, the coding sequence of SEQ ID NO: 218, the coding sequence of SEQ ID NO: 222 or the coding sequence of SEQ ID NO: 216 provided that the correction of the mutations is maintained and the sequence is associated with mating competence.

The degree of sequence identity is preferably determined in such a way that the number of residues of the shorter sequence which is involved in the comparison and has a "corresponding" counterpart in the other sequence is determined. For the purposes of the present invention the identity is preferably determined in the usual manner by using the usual algorithms. According to the invention only the cDNAs or amino acids of the respective mature proteins are used for the comparison. Similar, preferably identical sequence counterparts were determined according to the invention as homologue sequences by means of known computer programs. An example of such a program is the program Clone Manager Suite, which includes the program part Align Plus and is distributed by Scientific & Educational Software, Durham, N.C., U.S.A. A comparison of two DNA sequences or amino acid sequences as defined above is thereby carried out under the option local alignment either according to the FastScan—MaxScore method or according to the Needleman-Wunsch method, keeping the default values. The program version "Clone Manager 7 Align Plus 5" with the functions "Compare Two Sequences/Local Fast Scan-Max Score/Compare DNA sequences" or for amino acids "Compare Two Sequences/Global/Compare sequences as Amino Acids" was particularly used to calculate the identity according to the invention. The algorithms made available from the following sources were thereby used: Hirschberg, D. S. 1975. A linear space algorithm for computing maximal common subsequences. Commun Assoc Comput Mach 18:341-343; Myers, E. W. and W. Miller. 1988. Optimal alignments in linear space. CABIOS 4:1, 11-17; Chao, K-M, W. R. Pearson and W. Miller. 1992. Aligning two sequences within a specified diagonal band. CABIOS 8:5, 481-487.

The invention further relates to addition molecules and/or deletion molecules of the aforementioned polypeptides associated with mating competence. Thus, a polypeptide being associated with mating competence according to the invention may be elongated by adding further sequences at the N-terminal and/or C-terminal end, whereby the thus obtained amino acid sequences still have mating competence.

Sequence segments of the polypeptides being associated with mating competence may also be deleted according to the invention as long as the corrected mutations are maintained. The mutations, elongations and shortenings may be carried out in a way known per se and with the help of methods well known in the state of the art.

The production of such variants is generally known in the state of the art. For example, amino acid sequence variants of the polypeptides may be produced by mutation in the DNA. Processes for mutagenesis and changes in the nucleotide sequence are well known in the state of the art (cf. for example Tomic et al. NAR, 18:1656 (1990), Giebel and Sprtiz NAR, 18:4947 (1990)).

Details on appropriate amino acid substitutions which do not negatively influence the biological activity of the protein of interest can be found in the model by Dayhoff et al., Atlas of Protein Sequence and Structure, Natl. Biomed. Res. Found., Washington, D.C. (1978). Conservative substitutions such as the substitution of an amino acid by another one with similar properties are preferred. These substitutions may be divided into two main groups with altogether four subgroups, and a substitution in each subgroup is referred to as conservative substitution, which does preferably not influence the activity or the folding of the protein.

| aliphatic | non-polar | G A P |
| | | I L V |
| | polar and uncharged | C S T M N Q |
| | polar and charged | D E |
| | | K R |
| aromatic | | H F W Y |

The invention moreover relates to the corrected DNA sequences of the genes/genetic elements identified as associated with mating impairment in strains of Trichoderma reesei QM6a or strains derived therefrom. Specifically the invention relates to DNA sequences having or comprising nucleotides 888 to 2790 or the coding sequence of SEQ ID NO: 220, nucleotides 1263 to 1476 or the coding sequence of SEQ ID NO: 218, nucleotides 990 to 3107 or the coding sequence of SEQ ID NO: 222 or nucleotides 919 to 6039 or the coding sequence of SEQ ID NO: 216.

Moreover, disclosed are further those sequences comprising, with the claimed nucleotide sequence and the claimed parts thereof, a homology of at least 70%, preferably at least 80%, even more preferably 90% and in particular at least 95% as long as the corresponding sequences are associated with mating competence and the correction of the mutations is maintained. Preferably, the homology is 70 to 100%, more preferably 80 to 100%, most preferably 90 to 100%. The homology is defined as degree of identity. For this purpose, the degree of identity is preferably defined in the way that the number of residues of the shorter sequence which takes part in the comparison and which possesses a "corresponding" complement in the other sequence is determined. The homology is preferably determined by the usual way using the usual algorithms. Only the cDNAs of the corresponding mature proteins are taken into consideration for the comparison. Similar, preferably identical sequence complements are determined as homologous sequences by known computer programs. An example for such a program is the program Clone Manager Suite, which contains the program part Align Plus and which is distributed by Scientific & Educational Software, Durham, N.C., USA. For this purpose, a comparison of two DNA sequences as defined above is drawn, under the option local alignment either via the method FastScan—MaxScore or via the method Needleman-Wunsch with maintenance of the default values. According to the invention, the program version "Clone Manager 7 Align Plus 5" with the functions "Compare Two Sequences/Local Fast Scan-Max Score/Compare DNA sequences" has especially been used for the determination of the homology. For this purpose, the algorithms available from the following sources have been used: Hirschberg, D. S. (1975) A linear space algorithm for computing longest common subsequences, Commun Assoc Comput Mach 18:341-343; Myers, E. W. and W. Miller. (1988) Optimal alignments in linear space, CABIOS 4:1, 11-17; Chao, K-M, W. R. Pearson and W. Miller. (1992) Aligning two sequences within a specified diagonal band, CABIOS 8:5, 481-487.

The invention further relates to DNA sequences, which due to the degeneration of the genetic code are related to the sequences according the invention as well as allelic variations thereof. The degeneration of the genetic code can be caused by natural degeneration or due to a specially chosen codon usage. Natural allelic variants can be identified via the use of well-known techniques of the molecular biology like e.g. the polymerase chain reaction (PCR) and hybridisation techniques.

The invention also relates to DNA sequences which are associated with mating competence and which maintain the correction of the mating impairing mutations, comprising mutations, modifications or variations of the sequence. Furthermore, the invention also relates to sequences which hybridize with the aforementioned sequences under relaxed or stringent conditions. The following conditions are considered as stringent: hybridization at 65° C., 18 h in dextran sulphate solution (GenescreenPlus, DuPont), subsequent washing of the filter for 30 min, respectively, at first with 6×SSC, twice 2×SSC, twice 2×SSC, 0.1% SDS and finally with 0.2×SSC at 65° C. (membrane transfer and detection methods, Amersham).

A strain derived from *Trichoderma reesei* QM6a is, for example, a strain that has been derived by techniques known per se, such as either conventional mutagenesis (UV, gamma irradiation, nitrosoguanidine treatment and others) or by recombinant techniques from *T. reesei* QM6a in one or more successive steps, e.g. QM9123, QM9136, QM9414, MG4, MG5, RUT-C30, RUT-D4, RUT-M7, RUT-NG14, MCG77, MCG80, M5, M6, MHC15, MHC22, Kyowa X-31, Kyowa PC-1-4, Kyowa PC-3-7, TU-6 and various others which are known to a person skilled in the art. Said strains may be obtained from known culture collections, such as CBS, ATCC, DSMZ.

In the process of the invention for identifying the genes associated with mating impairment there is provided a first parental strain being a *Trichoderma reesei* QM6a strain having a MAT1-2 locus or a strain derived thereof. Said strain is crossed with a second strain which is a mating competent strain of a *Trichoderma reesei* (*Hypocrea jecorina*) having a complementary MAT1-1 locus. Said strain has been obtained by selecting *Hypocrea jecorina* (the teleomorph of *T. reesei*) wild type isolates from international type culture collections such as CBS (Centralbureau for Schimmelcultures) or ATCC (American Type Culture Collection) for those possessing a MAT1-1 allele and which form fertile fruiting bodies when crossed with *T. reesei* QM6a and its derivatives, or other *H. jecorina* strains that bear the MAT1-2 allele. The formation of fertile fruiting bodies can be checked by simple tests, such as by checking whether the thus obtained ascospores are able to germinate. Preferred examples of said strain are the strain CBS999.97 MAT1-1 or any other mating competent MAT1-1 *Trichoderma reesei* (*Hypocrea jecorina*) strain such as those listed by Druzhinina et al. 2010.

To obtain a QM6a/MAT1-1 strain being capable of performing successful sexual reproduction using QM6a/MAT1-2 as mating partner, strain QM6a/MAT1-1 is transformed with plasmids containing the functional variant(s) of the gene(s) identified in association with mating impairment in strain *T. reesei* QM6a/MAT1-2. Positive transformants were subjected to mating assays with *T. reesei* QM6a MAT1-2. Mating was verified by the formation of fertile fruiting bodies. Their fertility was tested by isolating ascospores and demonstrating that they, upon germination and growing into a mycelium, are capable of mating with the opposite mating partner.

Specifically, positive transformants of *T. reesei* QM6a/MAT1-1 complemented with repaired candidate gene(s) and *T. reesei* strain QM6a/MAT1-2 (ATCC13631) are co-cultured under suitable mating conditions for *Trichoderma reesei*. An exemplary protocol is given in Example 3. The fertility is tested by isolating ascospores from the fruiting bodies, germinating them and demonstrating that the resulting colonies are capable of mating. A positive mating outcome is verified by a visible morphological change, a cell-to-cell fusion and the formation of a dikaryon.

Since natural *H. jecorina* MAT1-1 strains can be crossed with *T. reesei* QM6a and derivatives and produce fertile fruiting bodies, whereas this does not happen with a *T. reesei* strain in which MAT1-2 has been exchanged against MAT1-1, the inventors concluded that the genome of *T. reesei* QM6a must contain certain genomic features responsible for this failure. Thus, the responsible genomic features and the corresponding genes could—in theory—be identified by sequencing the genome of one of the *H. jecorina* MAT1-1 strains. However, there is a serious obstacle against this strategy: wild-type strains of *T. reesei* and *H. jecorina* show on the average a 0.5-1.5% nucleotide variation in their genome. Given that the genome is 34.1 Mbp, this means that any two wild type strains of *T. reesei* and/or *H. jecorina* will be different in 170500-511500 nucleotides. Even though the majority of them will not occur in genes, and—if still so—may result in silent mutations, the number of genes that show a non-silent nucleotide exchange are likely too many to be used to identify the genes related to female sterility.

It was, therefore, decided to reduce this background of nucleotide differences by several repeated crossings of *T. reesei* QM6a first against *H. jecorina* MAT1-1, and subsequently against a strain from the resulting progeny. Owing to the laws of genetics, the progeny of a sexual cross should have 50% of the genome from the MAT1-1 parental strain and 50% of that of the MAT1-2 parent strain. When one of these offsprings with MAT1-1 is then again crossed, this will further reduce the genome content derived from the MAT1-1 strain by 50%, i.e. 25% of the original after $2^{nd}$ round of crossings. Further rounds will lead to 12.5 ($3^{rd}$), 6.25 ($4^{th}$), 3.125 ($5^{th}$) 1.56 ($6^{th}$), 0.78 ($7^{th}$) and 0.39% ($8^{th}$ round) of content derived from the original MAT1-1 genome. In view of the fact that *T. reesei/H. jecorina* have 9143 annotated genes, this reduces the number of candidate genes to test to 357, of which not all will bear a nucleotide difference between *T. reesei* and the MAT1-1 strain from the $8^{th}$ crossing generation. However, in order to even reduce this further, the progeny arising from the third crossing were separated into two strains that were separately crossed up to the eighth generation. In each step, the ability of the arising MAT1-1 progeny to still be capable of producing fertile fruiting bodies with QM6a was verified.

The backcrossing is repeated until a strain is obtained that is substantially identical to the parental strain, i.e. the first strain, by mathematical calculation: the backcrossing may be repeated for more than 8 cycles, if a higher likelihood of arriving at the correct genes is desired. Theoretically, a total of 19 back-crosses would be needed to arrive at a percentage of the MAT1-1 genome of 0.00014% (=1/9143; 9143 is the number of annotated genes in the *T. reesei* genome). The backcrossing is usually repeated for 5 to 19 cycles, preferably 6 to 12 cycles, more preferably 7 to 10 cycles, still more preferably 8 to 9 cycles and most preferably for 8 cycles. Hence, a strain that is substantially identical to the parental strains is defined in relation to the number of backcrossings that said strain has undergone. This means that the substantial identity between the backcrossed and the parental strain relates to the relationship between the genes associated with mating impairment and genes not associated with mating impairment as mathematically calculated on the basis of the number of backcrossings.

The progeny from the above back-crossing that is mating competent for crossing with a *Trichoderma reesei* (*Hypocrea jecorina*) having a MAT1-2 locus and contains the unmutated form of the genes for mating impairment/female sterility and/or a gene/genetic information not present in *Trichoderma reesei* QM6a is selected by first identifying those strains from the progeny that contain the MAT1-1 locus, and then verifying that it can produce fertile fruiting bodies with *T. reesei* QM6a (MAT1-2) by methods known per se.

Although by following the backcrossing strategy as outlined above it is basically feasible to obtain any combination of desirable genes (also the Female Sterility genes) transferred from the MAT1-1 background to the *Trichoderma reesei* QM6a lineage, use of the backcrossing strategy should be combined with a knock-out strategy to arrive at a mating competent QM6a strain or derivative carrying only the minimal set of complementing and defined female sterility genes as is obtained following the invention described.

Due to the randomness of genetic recombination it becomes increasingly unlikely to retain a defined set of desired genes from the MAT1-1 background and at the same time loose all the undesired background genes with no relevance to mating. Therefore after a certain advanced backcrossing generation the likelihood of loosing a female sterility gene in a crossing becomes greater than the likelihood of loosing a non-mating associated gene and the chance to obtain mating competent progeny with the minimal set of required female sterility genes will be miniscule. It is then therefore favourable to stop at an earlier point in a sequence of backcrosses with still numerous genes from the MAT1-1 female sterility gene donor non relevant to mating being retained in the resulting mating competent progeny.

Another disadvantage of attempting to generate mating competent *Trichoderma* strains merely by a backcrossing strategy will be that because of the necessity to stop at a stage where all female sterility genes have been assembled in a genome together with numerous random non-mating relevant genes from the MAT1-1 donor genome, every line will be different from another line generated in the same way with respect to these non-mating relevant genes, creating undesired heterogeneity. The use of the backcrossing strategy leads to a pool of candidate genes associated with mating impairment. Said pool of candidate genes is further refined by a targeted knock-out of each identified gene in a mating competent QM6a MAT 1-1 strain of *Trichoderma reesei* and the determination of the mating capability of the thus obtained *Trichoderma reesei* QM6a MAT 1-1 strain using the above described mating assay.

Since it is possible that more than a single gene associated with mating has become non-functional in *T. reesei* QM6a, and consequently the complementation with single genes would not lead to a gain of mating functionality, knock-out strains for all candidate genes in a mating competent *T. reesei* QM6a derivative were prepared. In this way any genes essential for mating would be identified whether solely responsible for mating deficiency in QM6a or being part of a group of inactivated essential mating genes. To this end, preferably a tku70 deleted version of strain CBS1/A8_02 (MAT1-1) is generated. The tku70 gene is part of the nonhomologous end joining (NHEJ) pathway present in *Trichoderma reesei* and other filamentous fungi. The knock-out of the tku70 gene leads to an increased homologous recombination efficiency of *Trichoderma reesei* (Guangtao et al. 2008) thus increasing the number of strains possessing the gene knocked-outs to be tested for their relevance in mating.

The knock-out of the tku70 gene as well as of the respective candidate genes may be accomplished by any technique that is suitable to render said gene inoperative such as partial, substantial or functional deletion, silencing, inactivation or down-regulation. Preferably a marker is inserted into the corresponding constructs to identify the corresponding knock-out organism. Corresponding techniques are known in the art. The knock-out organism allows to study the function of the knock-out gene, i.e. the mating behaviour of the organism.

In this way genes that when knocked-out do not abolish mating competence in mating competent strain CBS1/A8_02 Δtku70 (MAT 1-1) are identified as non-essential for mating and consequently removed from the list of candidate genes for female sterility in *Trichoderma reesei*.

The knock-out strategy may also be used to identify a mating-incompetent phenotype associated with the above-identified gene(s)/genetic elements. A mating-incompetent knock-out *Trichoderma reesei* QM6a strain is for example a wild-type *Hypocrea jecorina* strain in which the respective gene/genetic element as identified above has been rendered non-functional, for example by partial, substantial or functional deletion, silencing, inactivation or down-regulation. Corresponding methods are known per se.

The gene(s) associated with mating impairment is/are identified by sequencing the genome of the progenies selected as above and comparing it with the genome sequences of the parental strain *T. reesei* QM6a (the first strain as used above). To this end, the CLC Genomic Workbench (version 5.1, CLC bio, Arhus, Denmark) and de novo assembled with newbler (version 2.60, Roche/454, Brandford Conn., USA) and CLC Genomic Workbench was used to map the obtained sequences to the scaffolds of the *T. reesei* QM6a sequence scaffolds with BLAST (Altschul et al., 1990) and r2cat (Husemann and Stoye, 2010). Single nucleotide polymorphisms (SNPs) and insertions and deletions (Indels) between the QM6a reference sequence and the aligned sequences of the two backcrossed lines were identified using a customized version of Mauve (Rissman et al., 2009). SNPs and Indels were mapped to QM6a coding sequences using custom R scripts. Candidate genes were then manually tested for silent mutations, and mutations that lead to a conserved amino acid exchange (e.g. E vs. D, V vs. I etc) that does not interfere with the function of the putative protein were discarded. The respective nature of the mutations of course depends on the type of *Hypocrea* strain that is used for backcrossing. Hence, different mutations in the respective genes may be obtained by using a different strain of *Hypocrea*. Common to all mutation sets identified in genes correcting mating inability of *T. reesei* QM6a and derivatives will be mutations correcting mating disabling mutations in the respective QM6a versions of the gene.

Large DNA insertions in the backcrossed line which are not present in the published *T. reesei* QM6a genome sequence were identified in the following way. The results of a nucleotide comparison by the BLAST program between the different genome sequences of the backcrossed lines and QM6a were analyzed to identify regions which are absent in the genome sequence of QM6a by using a custom R script for identification of these sequences. The sequences identified in this process were extracted and the translated nucleotide sequences were used to search the protein database at the NCBI by a BLASTX search to find regions of similarity between the sequences.

The verification of the respective mutation is the restoration of the mating ability of the organism as evidenced by the formation of mature fruiting bodies with viable ascospores when crossing Trichoderma reesei QM6a having a MAT1-1 locus with a corresponding MAT1-2 strain of the same type as used for backcrossing.

To obtain genes directly associated with mating impairment the above identified genes are inserted into a Trichoderma reesei QM6a having a MAT1-1 locus or a strain derived thereof and crossing said strain with Trichoderma reesei QM6a having a MAT1-2 locus or a strain derived thereof, whereby the formation of fruiting bodies by Trichoderma reesei QM6a having a MAT1-1 locus having inserted said gene or a strain derived thereof is indicative of said direct association of said gene with said mating impairment. In the same way the contributory effect of a genetic element vis-à-vis mating behaviour may be verified.

By the above technique, of course, not only genes associated with mating impairment/female sterility may be identified but any other target gene that is associated with one or more functionally testable phenotypic feature(s) may be identified. Moreover, other organisms such as, for example, microorganisms or plants may be used instead of the Trichoderma reesei strains in the above system provided that said organisms are mating competent.

On the basis of the prior art it was not to be expected that by reintroducing non-mutated and thus functional genes associated with mating impairment or even female sterility that had lost their function in T. reesei QM6a (MAT1-2) into T. reesei QM6a, wherein the MAT1-2 locus has been replaced by the MAT1-1 locus, restores its ability to mate with T. reesei QM6a (MAT1-2) and other MAT1-2 derivatives thereof. The introduction of the above identified genes into industrial Trichoderma strains together with replacing the MAT1-2 locus with a MAT1-1 locus renders these strains capable of crossing with any other T. reesei (MAT1-2) strain, thus allowing for a rapid process for identifying male or female sterility genes and basically any target gene of interest.

The knowledge about the correlation of sequence deviations as depicted in Tables 3 and 4 and their functional implication concerning an improvement of the mating ability of Trichoderma reesei QM6a may be used to construct specific probes or arrays comprising specific probes for testing other microorganisms for genes associated with fertility. On the basis of the information of Tables 3 and 4 Vector Kits may be provided allowing restoration of the genes associated with the mating ability.

The invention further relates to a fungal strain of the genus Trichoderma (Hypocrea) suitable for use in the industrial production of a product of interest, wherein the strain has been obtained as outlined above and has been transformed with a gene encoding a product of interest.

A product of interest may be any product that may be of industrial use. Examples are proteins or polypeptides being useful for research purposes, diagnostic purposes, therapeutic purposes such as, for example, hormones, immunoglobulins, vaccines, antibacterial proteins, antiviral proteins, enzymes etc., purposes of nutrition or for technical applications. Preferred examples of proteins or polypeptides are food enzymes such as, for example, polygalacturonidases, pectin methylesterases, xylogalacturonoidases, rhamnogalacturonidases, arabinofuranosidases, arabanases/arabinanases, amylases, phytases, xylanases, cellulases, proteases, mannanases, transglutaminases, etc., animal feed enzymes such as, for example, phytases, xylanases, endoglucanases, mannanases and proteases, as well as technical enzymes such as, for example, cellulases, proteases, amylases, laccases, oxidoreductases, etc. A product of interest may also be a biopolymer.

The industrial production of a product of interest by the above Trichoderma is known to a person skilled in the art and is carried out according to fermentation methods established for fungal strains of the genus Trichoderma. For expressing and secreting the product of interest, the Trichoderma strain is cultivated under conventional conditions for the expression and secretion of the product of interest. The fungus is therefor inoculated or, respectively, initially grown on agar plates and a spore suspension or a mycelial suspension are used as an inoculum for a submerged fermentation. The fermentation is carried out on media containing the required C sources and N sources as well as trace elements and mineral salts. If inducible promoters are used, the medium should also contain the inducers or their precursors. The fermentation is carried out under control of temperature and pH value as well as of further fermentation conditions such as redox potential, partial oxygen content, etc. A controlled management of further C sources and N sources as well as of other components of the medium may also be effected (fed batch method). At the end of the fermentation the culture liquid containing the product of interest is separated from the biomass by known physical methods and the product of interest is isolated during this process.

The above restoration of the mating competence of Trichoderma reesei QM6a is associated with several unique advantages. Said process allows transforming Trichoderma reesei QM6a into an organism that more closely resembles the wild-type. The process allows to combine two or more advantageous genetic traits in Trichoderma reesei QM6a and its derivatives. Said traits are then transferred into the progenies of Trichoderma reesei QM6a and its derivatives. Hence, an already existing highly efficient producer of industrially interesting compounds may further be improved. The ability to cross strains of T. reesei can also be used to eliminate marker genes or other undesired genes which can be tested for by their phenotype, such as genes for secondary metabolism, pigment formation, undesired enzymes (e.g. proteases), morphology and asexual development and others.

BRIEF DESCRIPTION OF THE FIGURES

FIGS. 5A, 6A, 7A and 8A are the complementation vectors of the functional genes identified as essential for the mating competence of *Trichoderma reesei* QM6a. FIGS. 5B (SEQ ID NOs: 220/221), 6B (SEQ ID NOs: 216/217), 7B (SEQ ID NOs: 218/219) and 8B (SEQ ID NOs: 222/223) relate to the respective complementation genes per se in combination with a functional promoter and terminator. The promoter and terminator sequences may be exchanged by another equally functional promoter and/or terminator sequence.

The following examples illustrate and explain the subject-matter of the invention.

EXAMPLES

Example 1

1. Materials and Methods

Figure 1:
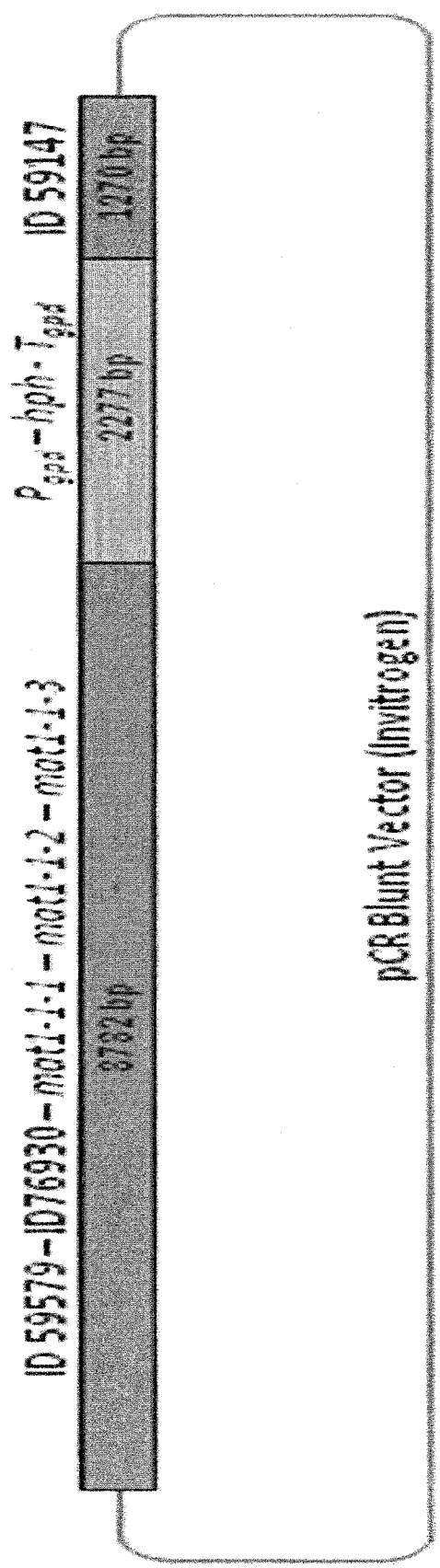
FIG. 1 is a schematic drawing of the vector for the direct replacement of the MAT1-2 locus in strain T. reesei QM6a by the MAT1-1 locus. As selection marker the hph gene (hygromycin resistance) was used. The hph cassette was inserted in the intergenic region between the mat1-1-3 gene and the gene with transcript ID 59147 (DNA lyase).
Figure 2:
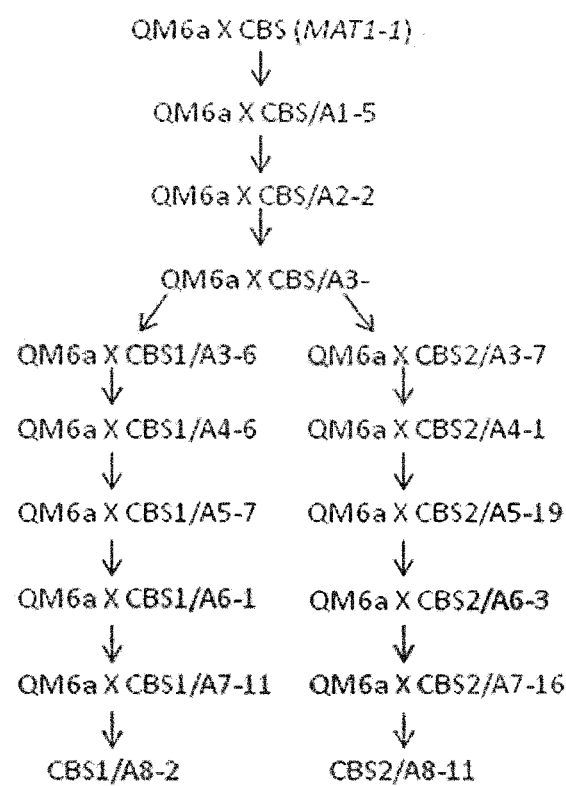
FIG. 2 is the scheme of the crossing of strain QM6a with strain CBS/MAT1-1. Progeny (carrying the MAT1-1 locus) of each crossing is crossed back with the parental strain QM6a. Of strains CBS1/A8-2 and CBS2/A8-11 DNA was extracted and subjected to whole genome sequencing.
Figure 3:
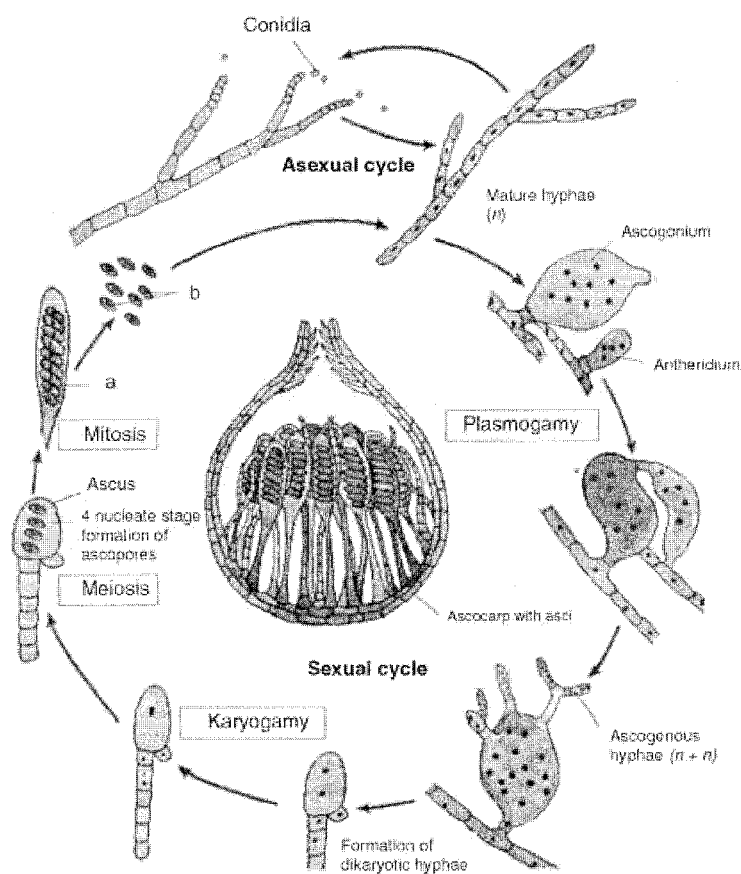
FIG. 3 is a schematic drawing of the sexual and asexual development in ascomycetes (Fazenda et al. 2008)
Figure 4:
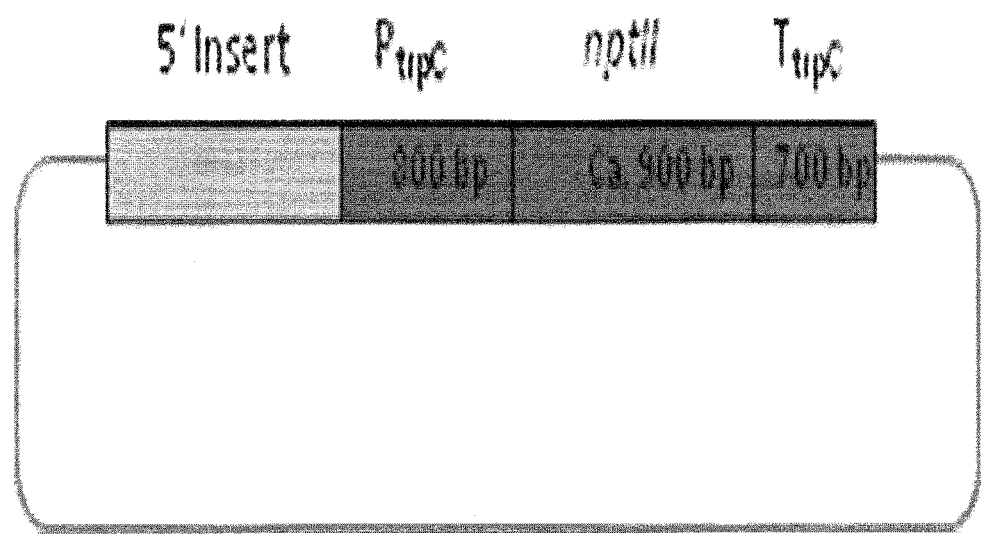
FIG. 4 is a schematic view of the principle vector construction to transform genes associated with mating impairment. The 5' insert corresponds to the different genes associated with mating impairment—here the gene with transcript ID Trire2_59740. Abbreviations: $P_{trpC}$—trpC promoter, nptll—gene conferring resistance to Geneticinsulfate G418; $T_{trpC}$—trpC terminator.

The strain described by Seidl et al. (2009) harbors, beside the MAT1-2 locus, also the MAT1-1 locus. This strain is able to reproduce sexually with different MAT1-1 and MAT1-2 carrying wildtype strains but not with the parental strain *T. reesei* QM6a (MAT1-2). To exclude that the still existing MAT1-2 locus (which resides at the original locus within the genome) is responsible for the malfunction of sexual reproduction in this strain, the MAT1-2 locus of *T. reesei* QM6a was directly and homologously exchanged by the MAT1-1 locus amplified from wildtype strain *H. jecorina* C.P.K. 1282 (G.J.S. 85-249). For the vector construction the MAT1-1 locus including upstream and downstream homolog regions was amplified from *H. jecorina* 1282 and cloned in the vector pCR blunt (obtainable from Life Technologies/Invitrogen). In a second step the hph gene (hygromycin B phosphotransferase gene) which confers resistance to Hygromycin was subcloned in the vector using the AvrII restriction site which is situated in the intergenic region between the gene mat 1-1-3 and the gene with transcript ID 59147 (endonuclease/DNA lyase). FIG. 1 gives a schematic overview of the vector construction and Table 1 gives the sequences of the primers used. Table 2 lists the exact positions of the genes within the MAT1-2 replacement vector. The complete sequence of the vector can be found in the Sequence listing as SEQ ID NO: 7.

For the transformation of *T. reesei* QM6a the replacement cassette was amplified from the vector by PCR using primers 1-2_replace_cassette_fw and 1-2_replace_cassette_rv. Per transformation reaction 10 µg of the replacement cassette were used. The resultant strain, which was named QM6a MAT1-2⇔MAT1-1, is able to act successfully as mating partner for MAT1-2 wildtype strains (e.g. CBS999.97) but mating with the parental strain *T. reesei* QM6a is not possible.

TABLE 2

Position of the different genes within the MAT1-2 replacement vector.

|  | Location within the plasmid |
|---|---|
| pCR blunt vector (obtainable from Life Technologies/Invitrogen) | 1-333 bp |
| ID 59579 (hypothetical protein) | 532-1505 bp |
| ID 76930 (hypothetical protein) | 2126-3004 bp (incl. the UTR: 2126-3394 bp) |
| mat 1-1-1 (alpha-domain protein) | 3806-5081 bp |
| mat 1-1-2 (A2-domain protein) | 5925-7445 bp |
| mat 1-1-3 (HMG protein) | 7988-8770 bp |
| hph (hygromycin B phosphotransferase) | 9122-11398 bp |
| ID 59147 (endonuclease/DNA lyase) | 11535-12673 bp (gene not fully included in the vector construction) |
| pCR blunt vector (obtainable from Life Technologies/Invitrogen) | 12674-15853 |

2. Identification of Mutated and Missing Genes

For the identification of genes that are mutated in *T. reesei* in comparison to *H. jecorina* wild-type MAT1-1 isolates capable of crossing with *T. reesei* MAT1-2, a genome sequencing approach was used. Since first attempts showed that the wild type isolates differed from QM6a (whose sequence is publically available; http://genome.jgi-psf.org/Trire2/Trire2.home.html) in >60.000 SNPs, most of this background was removed by sexual crossing of QM6a with a MAT1-1 strain followed by repeated cycles of backcrossing of the MAT1-1 progenies with QM6a. To this end, strain QM6a (MAT1-2) was crossed with strain CBS999.97 (MAT1-1) in two independent lines to obtain sexually competent strains carrying the MAT1-1 locus. Cultures from single ascospores carrying the MAT1-1 locus were crossed back several times with the parental strain QM6a to reduce the number of CBS999.97 specific genes which will allow the easier identification of candidate genes responsible for

TABLE 1

Sequences of the primers used for the construction of the vector
for the direct MAT locus replacement.

| Primer | Sequence | Amplicon length |
|---|---|---|
| MAT1-1 fuer pyr4 InFusion fw | GTGCTGGAATTCAGGCCTGGCTTGATGCTGCTAACCTTC SEQ ID NO: 1 | 10059 bp |
| MAT1-1 fuer pyr4 InFusion rv | TCTGCAGAATTCAGGCCTACTCCGCAAGATCAAATCCG SEQ ID NO: 2 | |
| hph_AvrII_fw | GTCCACAGAAGAGCCTAGGACCTCTTCGGCGATACATACTC SEQ ID NO: 3 | 2289 bp |
| hph_AvrII_rv | GGCTTTCACGGACCCTAGGTTGGAATCGACCTTGCATG SEQ ID NO: 4 | |
| 1-2_replace_cassette_fw | TGGAACGACTTTGTACGCAC SEQ ID NO: 5 | 9647 bp |
| 1-2_replace_cassette_rv | GGCACAAGAGGACAGACGAC SEQ ID NO: 6 | | female sterility (FS). By repeating this process over several generations two strains were generated which are nearly identical (>99% of their genome) to QM6a, but carry the MAT1-1 locus and are sexually competent. The genomes of the 8$^{th}$ generation of progeny from the two independent lines were then sequenced and by genome comparison candidate genes responsible for FS or necessary for fertility (e.g. CBS999.97 specific genes present in both lines) were identified.

Two libraries for each line were prepared, with 320 bp and 8 kbp insert size, respectively. DNA was fragmented using a Covaris S2 system (Covaris, Inc. Woburn, Mass.) and fragments were purified using the QIAquick PCR purification kit (Qiagen; Hilden, Germany). Paired-end libraries were prepared using the NEBNext DNA Sample Prep modules (New England Biolabs, Ipswich, Mass.) following the manufacturer's instructions. Briefly, fragments were end-repaired using Klenow and T4 DNA polymerases and phosphorylated with T4 polynucleotide kinase. Fragments were then 3'-adenylated using Klenow exo-DNA polymerase, and Illumina adapters were added using DNA ligase. Ligation products of ~400 bp were gel-purified using the Qiagen gel extraction kit (Qiagen; Hilden, Germany). To avoid guanine-cytosine (GC) bias introduced during the gel-purification step in the standard Illumina library preparation protocol, the gel slice was dissolved at room temperature instead of heating. The size-selected, adapter-modified DNA fragments were PCR-amplified using PE PCR primers 1.0 and 2.0 (Illumina, San Diego, Calif.) using Phusion DNA polymerase (New England Biolabs, Ipswich, Mass.) and protocol: polymerase activation (98° C. for 30 s), followed by 10 cycles (denaturation at 98° C. for 10 s, annealing at 65° C. for 30 s, and extension at 72° C. for 50 s) with a final, 5-min extension at 72° C. Libraries were purified and quantified using the Qubit HS Assay Kit (Invitrogen, Carlsbad, Calif., USA).

Cluster amplification was performed using the TruSeq PE Cluster Kit v5 on a cluster station, and all library were sequenced on one Illumina HiSeq 2000 lane using TruSeq SBS 36 Cycle Kits v5 (Illumina, San Diego, Calif.) using a 2×107 bp paired-end protocol. Sequencing image files were processed using the Sequencing Control Software (SCS) Real Time Analysis (RTA) v2.6 and CASAVA v1.7 to generate base calls and phred-like base quality scores and to remove failed reads.

Sequences of the two lines were quality filtered with using CLC Genomic Workbench (version 5.1, CLC bio, Arhus, Denmark) and de novo assembled with newbler (version 2.60, Roche/454, Brandford Conn., USA) and CLC Genomic Workbench. The resulting scaffolds and singleton contigs were mapped to the scaffolds of the *T. reesei* QM6a sequence scaffolds with BLAST (Altschul et al., 1990) and r2cat (Husemann and Stoye, 2010). Single nucleotide polymorphisms (SNPs) and insertions and deletions (Indels) between the QM6a reference sequence and the aligned sequences of the two backcrossed lines were identified using a customized version of Mauve (Rissman et al., 2009). SNPs and Indels were mapped to QM6a coding sequences using custom R scripts. As a result the following genes conferring female sterility to *T. reesei* QM6a were obtained (Table 3). Moreover the mutations in said genes that correlate with the observed mating impairment of *T. reesei* QM6a are indicated. Table 4 shows the genes that were found to be missing in *Trichoderma reesei* QM6a. Table 5 shows the genes associated with mating impairment in *T. reesei* QM6a as identified by the knock-out strategy.

TABLE 3

List of genes identified by repeated back crossings and sequencing and comparison with corresponding genes in QM6a as outlined above. The coding region change/amino acid change in relation to a corresponding functional gene is indicated (ins = insertion, del = deletion, fs = frameshift)

| SEQ. ID. No. | Trire2 | Current Data Base Annotation | Coding Region Change | Amino Acid Change |
|---|---|---|---|---|
| 8/9 | 55213 | smart00552, ADEAMc, tRNA-specific and double-stranded RNA adenosine deaminase | Trire2:55213:c.244C > T | p.Leu82Phe |
| | | | Trire2:55213:c.337C > G | p.His113Asp |
| | | | Trire2:55213:c.354T > G | p.Asp118Glu |
| | | | Trire2:55213:c.370A > G | p.Arg124Gly |
| | | | Trire2:55213:c.374G > A | p.Arg125Gln |
| | | | Trire2:55213:c.380C > A | p.Thr127Lys |
| | | | Trire2:55213:c.392A > G | p.Lys131Arg |
| | | | Trire2:55213:c.706G > A | p.Ala236Thr |
| | | | Trire2:55213:c.820G > C | p.Ala274Pro |
| | | | Trire2:55213:c.883G > A | p.Asp295Asn |
| | | | Trire2:55213:c.884A > G | p.Asp295Gly |
| | | | Trire2:55213:c.895G > A | p.Ala299Thr |
| | | | Trire2:55213:c.923A > G | p.His308Arg |
| | | | Trire2:55213:c.1025C > A | p.Ala342Asp |
| | | | Trire2:55213:c.1123G > A | p.Asp375Asn |
| | | | Trire2:55213:c.1180A > G | p.Thr394Ala |
| 10/11 | 103470 | SAD1, RdRP essential for MSUD | Trire2:103470:c.3297A > C | p.Arg1099Ser |
| | | | Trire2:103470:c.3159G > A | p.Met1053Ile |
| | | | Trire2:103470:c.3088A > G | p.Ile1030Val |
| | | | Trire2:103470:c.1153T > A | p.Phe385Ile |
| | | | Trire2:103470:c.947A > T | p.Lys316Met |
| | | | Trire2:103470:c.652C > T | p.Arg218Cys |
| | | | Trire2:103470:c.340A > G | p.Ile114Val |
| | | | Trire2:103470:c.319C > G | p.Gln107Glu |
| 12/13 | 21412 | unknown protein | Trire2:21412:c.37A > C | p.Ile13Leu |
| | | | Trire2:21412:c.126G > C | p.Lys42Asn |
| | | | Trire2:21412:c.280A > G | p.Thr94Ala |
| | | | Trire2:21412:c.289C > T | p.Pro97Ser |
| | | | Trire2:21412:c.290C > T | p.Pro97Leu |
| | | | Trire2:21412:c.305G > A | p.Gly102Glu |

TABLE 3-continued

List of genes identified by repeated back crossings and sequencing and comparison with corresponding genes in QM6a as outlined above. The coding region change/amino acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:21412:c.313G > A | p.Ala105Thr |
| | | | Trire2:21412:c.337A > G | p.Ile113Val |
| | | | Trire2:21412:c.339C > G | p.Ile113Met |
| | | | Trire2:21412:c.589G > A | p.Val197Met |
| | | | Trire2:21412:c.625C > A | p.Leu209Ile |
| 14/15 | 119991 | Unknown protein with a putative zinc finger binding motif | Trire2:119991:c.239G > A | p.Gly80Asp |
| | | | Trire2:119991:c.330G > C | p.Glu110Asp |
| | | | Trire2:119991:c.550C > T | p.Leu184Phe |
| | | | Trire2:119991:c.1013A > G | p.Glu338Gly |
| 16/17 | 120806 | Ca/calmodulin-binding protein CMK2 | Trire2:120806:c.3543G > T | p.Arg1181Ser |
| | | | Trire2:120806:c.3602A > T | p.Gln1201Leu |
| | | | Trire2:120806:c.3613T > G | p.Tyr1205Asp |
| | | | Trire2:120806:c.3625T > A | p.Tyr1209Asn |
| | | | Trire2:120806:c.3629T > G | p.Met1210Arg |
| | | | Trire2:120806:c.3646T > C | p.*1216Gln |
| 18/19 | 104898 | unknown protein | Trire2:104898:c.680A > T | p.Asp227Val |
| | | | Trire2:104898:c.683N > T | p.Xaa228Val |
| | | | Trire2:104898:c.698A > T | p.Gln233Leu |
| 20/21 | 46816 | GH3 | Trire2:46816:c.2093T > C | p.Met698Thr |
| | | | Trire2:46816:c.1100G > A | p.Arg367Lys |
| | | | Trire2:46816:c.258C > A | p.Asn86Lys |
| 22/23 | 59771 | UbiA prenyltransferase, putative | Trire2:59771:c.845C > T | p.Thr282Met |
| | | | Trire2:59771:c.743T > C | p.Ile248Thr |
| | | | Trire2:59771:c.73T > A | p.Ser25Thr |
| 24/25 | 59315 | PKS | Trire2:59315:c.11056A > G | p.Met3686Val |
| | | | Trire2:59315:c.10154T > C | p.Val3385Ala |
| | | | Trire2:59315:c.8871T > G | p.His2957Gln |
| | | | Trire2:59315:c.7406T > C | p.Phe2469Ser |
| | | | Trire2:59315:c.7381A > T | p.Thr2461Ser |
| | | | Trire2:59315:c.7312A > G | p.Lys2438Glu |
| | | | Trire2:59315:c.6818C > T | p.Ser2273Leu |
| | | | Trire2:59315:c.6592G > A | p.Val2198Ile |
| | | | Trire2:59315:c.5245A > C | p.Ile1749Leu |
| | | | Trire2:59315:c.1328A > G | p.Glu443Gly |
| | | | Trire2:59315:c.1327G > A | p.Glu443Lys |
| | | | Trire2:59315:c.1214G > A | p.Arg405Gln |
| | | | Trire2:59315:c.1033G > A | p.Asp345Asn |
| | | | Trire2:59315:c.107G > A | p.Arg36Lys |
| | | | Trire2:59315:c.102C > A | p.Asp34Glu |
| | | | Trire2:59315:c.70A > G | p.Thr24Ala |
| 26/27 | 36822 | unknown protein | Trire2:36822:c.105G > C | p.Arg35Ser |
| | | | Trire2:36822:c.403A > C | p.Met135Leu |
| | | | Trire2:36822:c.440T > G | p.Met147Arg |
| | | | Trire2:36822:c.596G > A | p.Arg199Lys |
| 28/29 | 3262 | succinate semialdehyde dehydrogenase (NADP) | Trire2:3262:c.35T > C | p.Ile12Thr |
| | | | Trire2:3262:c.301C > C | p.Ser101Pro |
| 30/31 | 105804 | PKS | Trire2:105804:c.3578A > G | p.Asn1193Ser |
| | | | Trire2:105804:c.3226A > G | p.Lys1076Glu |
| | | | Trire2:105804:c.2581C > T | p.His861Tyr |
| | | | Trire2:105804:c.2447C > T | p.Pro816Leu |
| | | | Trire2:105804:c.2281G > C | p.Val761Leu |
| | | | Trire2:105804:c.1993T > C | p.Cys665Arg |
| | | | Trire2:105804:c.1852A > C | p.Ile618Leu |
| | | | Trire2:105804:c.41G > A | p.Arg14His |
| 32/33 | 59402 | arsenate reductase Arc2 | Trire2:59402:c.11C > A | p.Thr4Lys |
| | | | Trire2:59402:c.32C > A | p.Thr11Lys |
| | | | Trire2:59402:c.37A > G | p.Ile13Val |
| | | | Trire2:59402:c.69C > A | p.Asp23Glu |
| | | | Trire2:59402:c.89G > C | p.Trp30Ser |
| | | | Trire2:59402:c.125C > T | p.Thr42Met |
| | | | Trire2:59402:c.138A > C | p.Leu46Phe |
| | | | Trire2:59402:c.157A > G | p.Asn53Asp |
| | | | Trire2:59402:c.158A > C | p.Asn53Thr |
| | | | Trire2:59402:c.232A > C | p.Ile78Leu |
| | | | Trire2:59402:c.245T > C | p.Ile82Thr |
| | | | Trire2:59402:c.251C > A | p.Ala84Asp |
| | | | Trire2:59402:c.331T > C | p.Tyr111His |
| 34/35 | 105816 | unknown protein | Trire2:105816:c.1409A > G | p.Glu470Gly |
| | | | Trire2:105816:c.1330T > A | p.Ser444Thr |
| | | | Trire2:105816:c.1271T > C | p.Leu424Ser |
| | | | Trire2:105816:c.1240A > G | p.Lys414Glu |
| | | | Trire2:105816:c.1228C > T | p.Pro410Ser |

TABLE 3-continued

List of genes identified by repeated back crossings and sequencing and comparison with corresponding genes in QM6a as outlined above. The coding region change/amino acid change in relation to a corresponding functional gene is indicated (ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:105816:c.1054T > G | p.Cys352Gly |
| | | | Trire2:105816:c.1039G > A | p.Ala347Thr |
| | | | Trire2:105816:c.986T > C | p.Phe329Ser |
| | | | Trire2:105816:c.868A > G | p.Thr290Ala |
| | | | Trire2:105816:c.857A > T | p.Asn286Ile |
| | | | Trire2:105816:c.815A > G | p.Asn272Ser |
| | | | Trire2:105816:c.803A > G | p.His268Arg |
| | | | Trire2:105816:c.611T > G | p.Leu204Arg |
| | | | Trire2:105816:c.369A > T | p.Gln123His |
| | | | Trire2:105816:c.294G > C | p.Glu98Asp |
| | | | Trire2:105816:c.53C > T | p.Thr18Ile |
| | | | Trire2:105816:c.26C > T | p.Thr9Ile |
| 36/37 | 59391 | GH27 | Trire2:59391:c.1308C > A | p.Ser436Arg |
| | | | Trire2:59391:c.1306A > G | p.Ser436Gly |
| | | | Trire2:59391:c.1195C > G | p.Arg399Gly |
| 38/39 | 59689 | GH2 β-mannosidase | Trire2:59689:c.898G > A | p.Val300Ile |
| | | | Trire2:59689:c.2465A > G | p.Lys822Arg |
| | | | Trire2:59689:c.2548A > G | p.Thr850Ala |
| | | | Trire2:59689:c.2705T > C | p.Ile902Thr |
| 40/41 | 105832 | unknown protein | Trire2:105832:c.140A > G | p.Asn47Ser |
| | | | Trire2:105832:c.544A > G | p.Ser182Gly |
| | | | Trire2:105832:c.748G > A | p.Gly250Ser |
| 42/43 | 59190 | MSF transporter | Trire2:59190:c.118G > A | p.Val40Met |
| | | | Trire2:59190:c.628C > T | p.Leu210Phe |
| | | | Trire2:59190:c.812C > G | p.Thr271Ser |
| | | | Trire2:59190:c.1345G > T | p.Val449Phe |
| 44/45 | 59351 | 1-aminocyclopropane-1-carboxylate synthase | Trire2:59351:c.1243T > C | p.Ser415Pro |
| | | | Trire2:59351:c.1233T > G | p.Asn411Lys |
| | | | Trire2:59351:c.1191G > A | p.Met397Ile |
| | | | Trire2:59351:c.1162G > C | p.Val388Leu |
| | | | Trire2:59351:c.1033T > C | p.Tyr345His |
| | | | Trire2:59351:c.819G > A | p.Met273Ile |
| | | | Trire2:59351:c.814T > G | p.Ser272Ala |
| | | | Trire2:59351:c.810G > T | p.Gln270His |
| | | | Trire2:59351:c.562C > T | p.Leu188Phe |
| | | | Trire2:59351:c.439A > T | p.Met147Leu |
| | | | Trire2:59351:c.433T > A | p.Leu145Met |
| | | | Trire2:59351:c.422C > T | p.Ser141Phe |
| | | | Trire2:59351:c.103G > A | p.Ala35Thr |
| | | | Trire2:59351:c.54G > T | p.Met18Ile |
| 46/47 | 121136 | unique protein | Trire2:121136:c.59T > G | p.Ile20Ser |
| | | | Trire2:121136:c.751G > A | p.Ala251Thr |
| | | | Trire2:121136:c.851A > G | p.Asn284Ser |
| 48/49 | 59558 | unknown protein | Trire2:59558:c.1339A > C | p.Met447Leu |
| | | | Trire2:59558:c.1318G > A | p.Val440Ile |
| | | | Trire2:59558:c.1208T > C | p.Ile403Thr |
| | | | Trire2:59558:c.1181G > A | p.Arg394Lys |
| | | | Trire2:59558:c.1156A > G | p.Arg386Gly |
| | | | Trire2:59558:c.1151A > G | p.Glu384Gly |
| | | | Trire2:59558:c.1006T > C | p.Phe336Leu |
| | | | Trire2:59558:c.911C > T | p.Ala304Val |
| | | | Trire2:59558:c.908G > T | p.Arg303Leu |
| | | | Trire2:59558:c.898A > G | p.Ile300Val |
| | | | Trire2:59558:c.599A > G | p.Asp200Gly |
| | | | Trire2:59558:c.587A > G | p.Lys196Arg |
| 50/51 | 105849 | Zn2Cys6 transcriptional regulator | Trire2:105849:c.18A > T | p.Lys6Asn |
| | | | Trire2:105849:c.41T > C | p.Val14Ala |
| | | | Trire2:105849:c.145G > A | p.Asp49Asn |
| | | | Trire2:105849:c.197C > T | p.Ser66Leu |
| | | | Trire2:105849:c.238T > G | p.Phe80Val |
| | | | Trire2:105849:c.499C > T | p.Arg167Cys |
| | | | Trire2:105849:c.563C > T | p.Thr188Ile |
| | | | Trire2:105849:c.575C > T | p.Ser192Phe |
| | | | Trire2:105849:c.599A > G | p.His200Arg |
| | | | Trire2:105849:c.620G > A | p.Arg207Lys |
| | | | Trire2:105849:c.662T > C | p.Phe221Ser |
| | | | Trire2:105849:c.685C > G | p.Leu229Val |
| | | | Trire2:105849:c.1741A > C | p.Ile581Leu |
| | | | Trire2:105849:c.1742T > A | p.Ile581Asn |
| | | | Trire2:105849:c.1970T > C | p.Leu657Ser |
| | | | Trire2:105849:c.2107C > T | p.Leu703Phe |
| | | | Trire2:105849:c.2111A > G | p.Asp704Gly |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:105849:c.2252T > C | p.Ile751Thr |
| | | | Trire2:105849:c.2276T > C | p.Val759Ala |
| | | | Trire2:105849:c.2279C > T | p.Thr760Met |
| | | | Trire2:105849:c.2395G > A | p.Asp799Asn |
| 52/53 | 59338 | D-Alanine aminotransferase | Trire2:59338:c.80G > A | p.Ser27Asn |
| | | | Trire2:59338:c.109T > C | p.Ser37Pro |
| | | | Trire2:59338:c.196A > G | p.Ser66Gly |
| | | | Trire2:59338:c.386A > G | p.Lys129Arg |
| | | | Trire2:59338:c.895G > A | p.Glu299Lys |
| | | | Trire2:59338:c.896A > G | p.Glu299Gly |
| | | | Trire2:59338:c.928A > G | p.Asn310Asp |
| 54/55 | 59723 | dipeptidyl peptidase 5 | Trire2:59723:c.241G > C | p.Asp81His |
| | | | Trire2:59723:c.278C > T | p.Ser93Leu |
| | | | Trire2:59723:c.437G > A | p.Arg146Gln |
| | | | Trire2:59723:c.805T > C | p.Ser269Pro |
| | | | Trire2:59723:c.836G > A | p.Gly279Asp |
| | | | Trire2:59723:c.892A > G | p.Thr298Ala |
| | | | Trire2:59723:c.902T > C | p.Val301Ala |
| | | | Trire2:59723:c.1096C > T | p.Gln366* |
| | | | Trire2:59723:c.1239G > T | p.Glu413Asp |
| | | | Trire2:59723:c.1412T > C | p.Leu471Pro |
| | | | Trire2:59723:c.1580T > A | p.Ile527Asn |
| | | | Trire2:59723:c.1638G > C | p.Gln546His |
| | | | Trire2:59723:c.1691A > G | p.Tyr564Cys |
| 56/57 | 59188 | unknown protein | Trire2:59188:c.1084A > G | p.Thr362Ala |
| | | | Trire2:59188:c.508A > G | p.Asn170Asp |
| | | | Trire2:59188:c.274T > C | p.Cys92Arg |
| | | | Trire2:59188:c.76A > G | p.Ile26Val |
| 58/59 | 59665 | unknown protein | Trire2:59665:c.350A > G | p.His117Arg |
| | | | Trire2:59665:c.365C > G | p.Ser122* |
| | | | Trire2:59665:c.490T > C | p.Ser164Pro |
| | | | Trire2:59665:c.761G > A | p.Gly254Glu |
| | | | Trire2:59665:c.1120C > T | p.Pro374Ser |
| | | | Trire2:59665:c.1136G > A | p.Arg379Lys |
| | | | Trire2:59665:c.1210T > A | p.Leu404Met |
| | | | Trire2:59665:c.1342A > G | p.Asn448Asp |
| | | | Trire2:59665:c.1395C > G | p.Ile465Met |
| | | | Trire2:59665:c.1415T > A | p.Ile472Asn |
| | | | Trire2:59665:c.1536G > T | p.Gln512His |
| | | | Trire2:59665:c.1585G > A | p.Val529Met |
| | | | Trire2:59665:c.1709C > T | p.Thr570Met |
| | | | Trire2:59665:c.1970T > C | p.Leu657Ser |
| | | | Trire2:59665:c.1987G > A | p.Ala663Thr |
| | | | Trire2:59665:c.2134G > A | p.Gly712Ser |
| 60/61 | 59669 | extracellular salicylate hydroxylase/monooxygenase, putative | Trire2:59669:c.305A > T | p.Lys102Met |
| | | | Trire2:59669:c.928A > G | p.Ile310Val |
| | | | Trire2:59669:c.943A > G | p.Arg315Gly |
| | | | Trire2:59669:c.1006T > C | p.Cys336Arg |
| | | | Trire2:59669:c.1297T > C | p.Phe433Leu |
| | | | Trire2:59669:c.1299C > G | p.Phe433Leu |
| | | | Trire2:59669:c.1304A > G | p.Lys435Arg |
| | | | Trire2:59669:c.1310T > C | p.Met437Thr |
| | | | Trire2:59669:c.1327T > C | p.Tyr443His |
| | | | Trire2:59669:c.1337C > T | p.Ala446Val |
| 62/63 | 105866 | unique protein | Trire2:105866:c.718C > T | p.Leu240Phe |
| | | | Trire2:105866:c.557A > C | p.Glu186Ala |
| | | | Trire2:105866:c.461A > G | p.His154Arg |
| | | | Trire2:105866:c.367C > T | p.Leu123Phe |
| | | | Trire2:105866:c.359A > G | p.Asp120Gly |
| | | | Trire2:105866:c.353A > G | p.Lys118Arg |
| | | | Trire2:105866:c.231T > G | p.His77Gln |
| 64/65 | 59700 | short-chain dehydrogenase, putative | Trire2:59700:c.747T > A | p.Asp249Glu |
| | | | Trire2:59700:c.597G > T | p.Gln199His |
| | | | Trire2:59700:c.320A > G | p.Lys107Arg |
| | | | Trire2:59700:c.245A > G | p.Lys82Arg |
| | | | Trire2:59700:c.224C > T | p.Ala75Val |
| | | | Trire2:59700:c.92A > G | p.Asp31Gly |
| | | | Trire2:59700:c.73C > T | p.Pro25Ser |
| | | | Trire2:59700:c.13G > A | p.Val5Ile |
| | | | Trire2:59700:c.10A > G | p.Asn4Asp |

TABLE 3-continued

List of genes identified by repeated back crossings and sequencing and comparison with corresponding genes in QM6a as outlined above. The coding region change/amino acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| 66/67 | 105884 | short chain type dehydrogenase, putative | Trire2:105884:c.58G > A | p.Ala20Thr |
| | | | Trire2:105884:c.73T > C | p.Tyr25His |
| | | | Trire2:105884:c.109A > G | p.Asn37Asp |
| | | | Trire2:105884:c.244G > C | p.Gly82Arg |
| | | | Trire2:105884:c.385G > T | p.Val29Phe |
| | | | Trire2:105884:c.401T > G | p.Val34Gly |
| | | | Trire2:105884:c.488G > A | p.Gly163Glu |
| | | | Trire2:105884:c.541A > C | p.Ser181Arg |
| | | | Trire2:105884:c.662C > T | p.Pro221Leu |
| 68/69 | 59582 | unknown protein | Trire2:59582:c.16A > G | p.Ile6Val |
| | | | Trire2:59582:c.58G > A | p.Val20Ile |
| | | | Trire2:59582:c.61G > A | p.Asp21Asn |
| | | | Trire2:59582:c.455A > G | p.Glu152Gly |
| | | | Trire2:59582:c.637G > A | p.Asp213Asn |
| | | | Trire2:59582:c.643A > G | p.Thr215Ala |
| | | | Trire2:59582:c.724C > T | p.Leu242Phe |
| | | | Trire2:59582:c.741G > C | p.Glu247Asp |
| | | | Trire2:59582:c.797C > G | p.Ala266Gly |
| | | | Trire2:59582:c.806C > T | p.Thr269Ile |
| | | | Trire2:59582:c.874C > T | p.Leu292Phe |
| 70/71 | 59760 | Zn2Cys6 transcriptional regulator | Trire2:59760:c.155G > A | p.Ser52Asn |
| | | | Trire2:59760:c.188A > G | p.Asn63Ser |
| | | | Trire2:59760:c.232G > A | p.Ala78Thr |
| | | | Trire2:59760:c.242C > T | p.Thr81Ile |
| | | | Trire2:59760:c.300T > A | p.His100Gln |
| | | | Trire2:59760:c.353G > A | p.Arg118Lys |
| | | | Trire2:59760:c.370G > C | p.Glu124Gln |
| | | | Trire2:59760:c.401G > A | p.Arg134Gln |
| | | | Trire2:59760:c.471G > C | p.Met157Ile |
| | | | Trire2:59760:c.472A > G | p.Asn158Asp |
| | | | Trire2:59760:c.542C > T | p.Ser181Leu |
| | | | Trire2:59760:c.640T > G | p.Ser214Ala |
| | | | Trire2:59760:c.692A > G | p.Glu231Gly |
| | | | Trire2:59760:c.694G > A | p.Asp232Asn |
| | | | Trire2:59760:c.760G > A | p.Val254Ile |
| | | | Trire2:59760:c.929G > C | p.Cys310Ser |
| | | | Trire2:59760:c.964A > C | p.Thr322Pro |
| | | | Trire2:59760:c.1261T > C | p.Cys421His* |
| | | | Trire2:59760:c.1262G > A | p.Cys421His* |
| | | | Trire2:59760:c.1306A > G | p.Lys436Glu |
| | | | Trire2:59760:c.1441G > A | p.Ala481Thr |
| | | | Trire2:59760:c.1478G > A | p.Arg493Gln |
| | | | Trire2:59760:c.1672T > G | p.Ser558Ala |
| | | | Trire2:59760:c.1796C > T | p.Pro599Leu |
| 72/73 | 76690 | unknown protein | Trire2:76690:c.1729A > G | p.Lys577Glu |
| | | | Trire2:76690:c.1720T > C | p.Cys574Arg |
| | | | Trire2:76690:c.1601C > T | p.Thr534Ile |
| | | | Trire2:76690:c.1076T > A | p.Phe359Tyr |
| | | | Trire2:76690:c.1039G > A | p.Val347Ile |
| | | | Trire2:76690:c.628G > A | p.Ala210Thr |
| 74/75 | 105894 | unknown protein | Trire2:105894:c.196A > G | p.Ser66Gly |
| | | | Trire2:105894:c.188C > T | p.Thr63Ile |
| | | | Trire2:105894:c.100G > A | p.Ala34Thr |
| 76/77 | 59372 | unknown protein | Trire2:59372:c.541A > C | p.Thr181Pro |
| | | | Trire2:59372:c.392G > C | p.Ser131Thr |
| | | | Trire2:59372:c.380C > T | p.Pro127Leu |
| | | | Trire2:59372:c.6A > T | p.Leu2Phe |
| 78/79 | 105924 | GT1 | Trire2:105924:c.1390A > C | p.Ile464Leu |
| | | | Trire2:105924:c.1369A > G | p.Ile457Val |
| | | | Trire2:105924:c.383C > T | p.Thr128Ile |
| 80/81 | 59368 | unknown protein, Duf341 | Trire2:59368:c.626A > G | p.Asp209Gly |
| 82/83 | 35726 | Subtilisin like protease | Trire2:35726:c.2675A > G | p.Lys892Arg |
| | | | Trire2:35726:c.2572C > G | p.Pro858Ala |
| | | | Trire2:35726:c.2143T > G | p.Ser715Ala |
| | | | Trire2:35726:c.2122A > G | p.Ile708Val |
| | | | Trire2:35726:c.2029A > T | p.Thr677Ser |
| | | | Trire2:35726:c.1874T > A | p.Phe625Tyr |
| | | | Trire2:35726:c.1837T > C | p.Ser613Pro |
| | | | Trire2:35726:c.1814C > A | p.Thr605Lys |
| | | | Trire2:35726:c.1234A > G | p.Asn412Asp |
| | | | Trire2:35726:c.1205G > A | p.Gly402Asp |
| | | | Trire2:35726:c.431A > T | p.Gln144Leu |

TABLE 3-continued

List of genes identified by repeated back crossings and sequencing and comparison with corresponding genes in QM6a as outlined above. The coding region change/amino acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:35726:c.400C > A | p.Pro134Thr |
| | | | Trire2:35726:c.305T > C | p.Val102Ala |
| | | | Trire2:35726:c.302C > T | p.Ser101Phe |
| | | | Trire2:35726:c.208C > T | p.Leu70Phe |
| 84/85 | 105931 | GH20 | Trire2:105931:c.35C > T | p.Ala12Val |
| | | | Trire2:105931:c.157A > G | p.Asn53Asp |
| | | | Trire2:105931:c.197G > A | p.Gly66Glu |
| | | | Trire2:105931:c.217A > G | p.Asn73Asp |
| | | | Trire2:105931:c.277G > A | p.Asp93Asn |
| | | | Trire2:105931:c.373A > T | p.Thr125Ser |
| | | | Trire2:105931:c.406G > A | p.Gly136Arg |
| | | | Trire2:105931:c.430A > G | p.Ile144Val |
| | | | Trire2:105931:c.481A > G | p.Ile161Val |
| | | | Trire2:105931:c.617G > A | p.Gly206Asp |
| | | | Trire2:105931:c.687C > A | p.Asp229Glu |
| | | | Trire2:105931:c.794C > G | p.Ala265Gly |
| | | | Trire2:105931:c.925A > G | p.Ile309Val |
| | | | Trire2:105931:c.1033G > T | p.Ala345Ser |
| | | | Trire2:105931:c.1546A > G | p.Ser516Gly |
| | | | Trire2:105931:c.1606A > G | p.Lys536Glu |
| | | | Trire2:105931:c.1717C > T | p.Leu573Phe |
| 86/87 | 3310 | C2H2 transcriptional regulator | Trire2:3310:c.254C > G | p.Thr85Ser |
| | | | Trire2:3310:c.373A > G | p.Thr125Ala |
| | | | Trire2:3310:c.419A > T | p.Asn140Ile |
| 88/89 | 76758 | maltose permease | Trire2:76758:c.1639G > T | p.Ala547Ser |
| | | | Trire2:76758:c.1633C > A | p.Pro545Thr |
| | | | Trire2:76758:c.890C > A | p.Thr297Lys |
| 90/91 | 59578 | GH13 | Trire2:59578:c.191T > C | p.Val64Ala |
| | | | Trire2:59578:c.349G > C | p.Glu117Gln |
| | | | Trire2:59578:c.931G > A | p.Glu311Lys |
| | | | Trire2:59578:c.1190G > A | p.Gly397Asp |
| | | | Trire2:59578:c.1203C > G | p.Asp401Glu |
| | | | Trire2:59578:c.1264C > G | p.Gln422Glu |
| | | | Trire2:59578:c.1477A > G | p.Thr493Ala |
| | | | Trire2:59578:c.1546A > G | p.Thr516Ala |
| | | | Trire2:59578:c.1582A > C | p.Ile528Leu |
| | | | Trire2:59578:c.1598C > T | p.Ser533Phe |
| | | | Trire2:59578:c.1700C > A | p.Ala567Glu |
| 92/93 | 59751 | Ribonucleases P/MRP protein subunit POP1 containing protein | Trire2:59751:c.2442G > T | p.Lys814Asn |
| | | | Trire2:59751:c.2414T > C | p.Leu805Ser |
| | | | Trire2:59751:c.2366T > C | p.Leu789Ser |
| | | | Trire2:59751:c.2352G > C | p.Met784Ile |
| | | | Trire2:59751:c.2312C > A | p.Pro771Gln |
| | | | Trire2:59751:c.2249T > C | p.Leu750Pro |
| | | | Trire2:59751:c.2092A > C | p.Thr698Pro |
| | | | Trire2:59751:c.2071G > A | p.Ala691Thr |
| | | | Trire2:59751:c.2062G > T | p.Ala688Ser |
| | | | Trire2:59751:c.1616C > T | p.Thr539Ile |
| | | | Trire2:59751:c.1495A > G | p.Ser499Gly |
| | | | Trire2:59751:c.1494T > G | p.Asp498Glu |
| | | | Trire2:59751:c.1438A > G | p.Asn480Asp |
| | | | Trire2:59751:c.1289A > G | p.Asp430Gly |
| | | | Trire2:59751:c.1253T > C | p.Val418Ala |
| | | | Trire2:59751:c.977T > A | p.Ile326Asn |
| | | | Trire2:59751:c.578A > G | p.Lys193Arg |
| 94/95 | 27992 | PTH11 GPCR | Trire2:27992:c.266A > C | p.Asn89Thr |
| | | | Trire2:27992:c.310C > T | p.Leu104Phe |
| | | | Trire2:27992:c.361T > G | p.Ser121Ala |
| | | | Trire2:27992:c.445G > A | p.Val149Met |
| | | | Trire2:27992:c.517A > T | p.Ile173Phe |
| | | | Trire2:27992:c.673T > A | p.Ser225Thr |
| | | | Trire2:27992:c.747A > G | p.Ile249Met |
| | | | Trire2:27992:c.904A > G | p.Ile302Val |
| | | | Trire2:27992:c.1030A > G | p.Ile344Val |
| 96/97 | 59381 | SAM-dependent methyltransferases | Trire2:59381:c.865T > C | p.Ser289Pro |
| 98/99 | 3363 | unknown protein, 9 TM | Trire2:3363:c.934A > G | p.Ile312Val |
| | | | Trire2:3363:c.532T > A | p.Phe178Ile |
| | | | Trire2:3363:c.524T > C | p.Val175Ala |
| | | | Trire2:3363:c.499G > A | p.Ala167Thr |
| | | | Trire2:3363:c.408A > C | p.Gln136His |
| | | | Trire2:3363:c.397G > A | p.Val133Ile |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| 100/101 | 27554 | GH61 | Trire2:27554:c.220T > C | p.Ser74Pro |
| | | | Trire2:27554:c.754C > A | p.Pro252Thr |
| 102/103 | 76852 | GH2 | Trire2:76852:c.1363C > G | p.Leu455Val |
| | | | Trire2:76852:c.892G > A | p.Asp298Asn |
| | | | Trire2:76852:c.890C > G | p.Ala297Gly |
| | | | Trire2:76852:c.415G > C | p.Glu139Gln |
| | | | Trire2:76852:c.355A > G | p.Lys119Glu |
| | | | Trire2:76852:c.218G > A | p.Gly73Glu |
| 104/105 | 76862 | palmitoyltransferase PFA5, putative | Trire2:76862:c.243A > C | p.Lys81Asn |
| 106/107 | 59740 | transcriptional regulator, unknown | Trire2:59740:c.730C > T | p.Pro244Ser |
| | | | Trire2:59740:c.868G > A | p.Gly290Ser |
| 108/109 | 59396 | unknown protein | Trire2:59396:c.1027A > C | p.Ile343Leu |
| | | | Trire2:59396:c.1004A > C | p.Asn335Thr |
| | | | Trire2:59396:c.985C > A | p.His329Asn |
| | | | Trire2:59396:c.101G > C | p.Cys34Ser |
| | | | Trire2:59396:c.92A > T | p.Tyr31Phe |
| 110/111 | 76887 | aspartyl protease | Trire2:76887:c.146G > A | p.Arg49His |
| | | | Trire2:76887:c.359G > A | p.Arg120Lys |
| | | | Trire2:76887:c.1226T > C | p.Val409Ala |
| | | | Trire2:76887:c.1348A > G | p.Asn450Asp |
| 112/113 | 59270 | unknown protein | Trire2:59270:c.1241G > C | p.Gly414Ala |
| | | | Trire2:59270:c.307G > A | p.Ala103Thr |
| | | | Trire2:59270:c.223T > A | pleu75Ile |
| | | | Trire2:59270:c.137T > C | p.Ile46Thr |
| | | | Trire2:59270:c.112G > A | p.Val38Ile |
| 114/115 | 3397 | UBX domain-containing protein | Trire2:3397:c.328A > G | p.Thr110Ala |
| | | | Trire2:3397:c.394C > T | p.Pro132Ser |
| | | | Trire2:3397:c.475A > G | p.Ser159Gly |
| 116/117 | 3400 | RRM domain-containing protein | Trire2:3400:c.146A > G | p.Asn49Ser |
| 118/119 | 106164 | short chain dehydrogenase/reductase | Trire2:106164:c.61T > C | p.Phe21Leu |
| | | | Trire2:106164:c.70A > G | p.Asn24Asp |
| | | | Trire2:106164:c.71A > G | p.Asn24Ser |
| | | | Trire2:106164:c.181A > G | p.Thr61Ala |
| | | | Trire2:106164:c.595A > G | p.Ile199Val |
| | | | Trire2:106164:c.931G > A | p.Val311Ile |
| | | | Trire2:106164:c.974G > A | p.Gly325Glu |
| 120/121 | 59364 | Sexual differentiation process protein ISP4 | Trire2:59364:c.315T > A | p.His105Gln |
| | | | Trire2:59364:c.316C > G | p.Arg106Gly |
| | | | Trire2:59364:c.564C > A | p.Phe188Leu |
| | | | Trire2:59364:c.565C > A | p.Leu189Met |
| | | | Trire2:59364:c.588C > G | p.Cys196Trp |
| | | | Trire2:59364:c.607G > A | p.Val203Ile |
| | | | Trire2:59364:c.1285G > A | p.Val429Ile |
| | | | Trire2:59364:c.1622C > T | p.Ser541Leu |
| | | | Trire2:59364:c.2531C > T | p.Pro844Leu |
| 122/123 | 3422 | oxidoreductase, putative | Trire2:3422:c.985G > A | p.Ala329Thr |
| | | | Trire2:3422:c.1029G > C | p.Glu343Asp |
| | | | Trire2:3422:c.1204G > A | p.Ala402Thr |
| 124/125 | 47930 | Mitochondrial oxoglutarate/malate carrier proteins | Trire2:47930:c.110A > C | p.Asn37Thr |
| 126/127 | 110423 | Ribonuclease CAF1 | Trire2:110423:c.460G > A | p.Ala154Thr |
| 128/129 | 110648 | unknown protein | Trire2:110648:c.3523C > A | p.Leu1175Met |
| | | | Trire2:110648:c.3317A > G | p.Asn1106Ser |
| | | | Trire2:110648:c.3148A > T | p.Thr1050Ser |
| | | | Trire2:110648:c.3140A > T | p.Tyr1047Phe |
| | | | Trire2:110648:c.2903A > G | p.Lys968Arg |
| | | | Trire2:110648:c.2759C > G | p.Ala920Gly |
| | | | Trire2:110648:c.2651T > C | p.Leu884Ser |
| | | | Trire2:110648:c.2207G > A | p.Arg736His |
| | | | Trire2:110648:c.2204T > C | p.Val735Ala |
| | | | Trire2:110648:c.2122T > C | p.Ser708Pro |
| | | | Trire2:110648:c.2095A > G | p.Thr699Ala |
| | | | Trire2:110648:c.2081A > G | p.Gln694Arg |
| | | | Trire2:110648:c.2039T > C | p.Leu680Pro |
| | | | Trire2:110648:c.1991A > G | p.His664Arg |
| | | | Trire2:110648:c.1727T > C | p.Leu576Pro |
| | | | Trire2:110648:c.1657T > C | p.Phe553Leu |
| | | | Trire2:110648:c.1627T > C | p.Tyr543His |
| | | | Trire2:110648:c.1388C > A | p.Pro463His |
| | | | Trire2:110648:c.1220C > G | p.Ser407Cys |
| | | | Trire2:110648:c.1168C > T | p.Pro390Ser |
| | | | Trire2:110648:c.1025G > A | p.Cys342Tyr |
| | | | Trire2:110648:c.968T > C | p.Leu323Pro |

TABLE 3-continued

List of genes identified by repeated back crossings and sequencing and comparison with corresponding genes in QM6a as outlined above. The coding region change/amino acid change in relation to a corresponding functional gene is indicated (ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:110648:c.915T > A | p.His305Gln |
| | | | Trire2:110648:c.877C > G | p.Pro293Ala |
| | | | Trire2:110648:c.551A > G | p.Lys184Arg |
| | | | Trire2:110648:c.523T > C | p.Cys175Arg |
| | | | Trire2:110648:c.410T > C | p.Leu137Ser |
| | | | Trire2:110648:c.132A > C | p.Glu44Asp |
| 130/131 | 51217 | sulfate transporter, putative | Trire2:51217:c.493T > A | p.Phe165Ile |
| | | | Trire2:51217:c.334G > A | p.Val112Ile |
| 132/133 | 67470 | unknown protein | Trire2:67470:c.13G > T | p.Ala5Ser |
| | | | Trire2:67470:c.343A > G | p.Thr115Ala |
| | | | Trire2:67470:c.349C > T | p.Leu117Phe |
| | | | Trire2:67470:c.356C > T | p.Ala119Val |
| | | | Trire2:67470:c.623T > G | p.Val208Gly |
| | | | Trire2:67470:c.662A > G | p.Gln221Arg |
| | | | Trire2:67470:c.820A > G | p.Ile274Val |
| | | | Trire2:67470:c.851C > T | p.Thr284Met |
| | | | Trire2:67470:c.1183A > G | p.Lys395Glu |
| | | | Trire2:67470:c.1231C > G | p.Leu411Val |
| | | | Trire2:67470:c.1381T > C | p.Ser461Pro |
| 134/135 | 67350 | unknown unknown protein | Trire2:67350:c.4409C > T | p.Ala1470Val |
| | | | Trire2:67350:c.4187A > T | p.Lys1396Met |
| | | | Trire2:67350:c.3550G > A | p.Ala1184Thr |
| | | | Trire2:67350:c.3437G > A | p.Arg1146Gln |
| | | | Trire2:67350:c.3016A > G | p.Thr1006Ala |
| | | | Trire2:67350:c.2856C > G | p.Asp952Glu |
| | | | Trire2:67350:c.2553T > G | p.Asp851Glu |
| | | | Trire2:67350:c.931C > A | p.His311Asn |
| 136/137 | 81576 | assimilatory sulfite reductase, alpha subunit | Trire2:81576:c.70A > G | p.Ser24Gly |
| | | | Trire2:81576:c.471A > C | p.Glu157Asp |
| | | | Trire2:81576:c.1324T > C | p.Phe442Leu |
| | | | Trire2:81576:c.1796G > A | p.Ser599Asn |
| | | | Trire2:81576:c.1801G > A | p.Ala601Thr |
| 138/139 | 81593 | MSF permease | Trire2:81593:c.55G > A | p.Ala19Thr |
| | | | Trire2:81593:c.373A > G | p.Thr125Ala |
| | | | Trire2:81593:c.672A > C | p.Glu224Asp |
| | | | Trire2:81593:c.679G > A | p.Val227Ile |
| | | | Trire2:81593:c.878A > G | p.Lys293Arg |
| | | | Trire2:81593:c.1212G > C | p.Leu404Phe |
| | | | Trire2:81593:c.1237G > T | p.Ala413Ser |
| | | | Trire2:81593:c.1321C > T | p.His441Tyr |
| 140/141 | 51868 | unknown protein | Trire2:51868:c.286T > C | p.Cys96Arg |
| | | | Trire2:51868:c.409G > T | p.Gly137Cys |
| | | | Trire2:51868:c.1066C > G | p.Gln356Glu |
| 142/143 | 111374 | unique protein | Trire2:111374:c.22C > A | p.Pro8Thr |
| | | | Trire2:111374:c.59T > C | p.Ile20Thr |
| | | | Trire2:111374:c.79C > T | p.Pro27Ser |
| | | | Trire2:111374:c.88G > A | p.Gly30Arg |
| | | | Trire2:111374:c.104A > G | p.Asn35Ser |
| | | | Trire2:111374:c.107A > T | p.Lys36Ile |
| | | | Trire2:111374:c.118A > G | p.Lys40Glu |
| | | | Trire2:111374:c.122T > C | p.Met41Thr |
| | | | Trire2:111374:c.129G > C | p.Gln43His |
| | | | Trire2:111374:c.131C > G | p.Thr44Arg |
| | | | Trire2:111374:c.137C > T | p.Thr46Ile |
| | | | Trire2:111374:c.143A > G | p.Asp48Gly |
| | | | Trire2:111374:c.176G > A | p.Gly59Glu |
| | | | Trire2:111374:c.213T > A | p.His71Gln |
| | | | Trire2:111374:c.283T > C | p.Tyr95His |
| | | | Trire2:111374:c.338C > T | p.Ser113Phe |
| | | | Trire2:111374:c.357G > T | p.Leu119Phe |
| | | | Trire2:111374:c.431C > G | p.Thr144Arg |
| | | | Trire2:111374:c.467A > C | p.Asp156Ala |
| | | | Trire2:111374:c.570T > G | p.His190Gln |
| | | | Trire2:111374:c.574A > T | p.Thr192Ser |
| | | | Trire2:111374:c.581C > A | p.Ala194Glu |
| | | | Trire2:111374:c.760G > A | p.Asp254Asn |
| | | | Trire2:111374:c.806G > A | p.Arg269Lys |
| | | | Trire2:111374:c.837G > C | p.Gln279His |
| | | | Trire2:111374:c.908G > C | p.Arg303Thr |
| | | | Trire2:111374:c.993G > T | p.Glu331Asp |
| | | | Trire2:111374:c.1002A > C | p.Gln334His |
| | | | Trire2:111374:c.1055T > C | p.Val352Ala |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:111374:c.1166A > G | p.Lys389Arg |
| | | | Trire2:111374:c.1172T > C | p.Phe391Ser |
| | | | Trire2:111374:c.1182G > T | p.Lys394Asn |
| | | | Trire2:111374:c.1205G > A | p.Cys402Tyr |
| | | | Trire2:111374:c.1208A > T | p.Lys403Ile |
| | | | Trire2:111374:c.1237A > G | p.Ile413Val |
| | | | Trire2:111374:c.1247A > G | p.Asn416Ser |
| | | | Trire2:111374:c.1253A > T | p.Lys418Ile |
| 144/145 | 123786 | NRPS | Trire2:123786:c.49556A > G | p.Asn16519Ser |
| | | | Trire2:123786:c.49541A > T | p.Glu16514Val |
| | | | Trire2:123786:c.49307C > T | p.Ala16436Val |
| | | | Trire2:123786:c.48743A > G | p.Asn16248Ser |
| | | | Trire2:123786:c.48382G > A | p.Val16128Ile |
| | | | Trire2:123786:c.48125A > T | p.Glu16042Val |
| | | | Trire2:123786:c.47219C > T | p.Ala15740Val |
| | | | Trire2:123786:c.47168G > C | p.Ser15723Thr |
| | | | Trire2:123786:c.47072T > C | p.Val15691Ala |
| | | | Trire2:123786:c.47026A > G | p.Ile15676Val |
| | | | Trire2:123786:c.46894C > T | p.Leu15632Phe |
| | | | Trire2:123786:c.46761C > G | p.Asp15587Glu |
| | | | Trire2:123786:c.46759G > C | p.Asp15587His |
| | | | Trire2:123786:c.46676T > C | p.Val15559Ala |
| | | | Trire2:123786:c.46574A > G | p.Asp15525Gly |
| | | | Trire2:123786:c.46517T > C | p.Ile15506Thr |
| | | | Trire2:123786:c.46498T > G | p.Ser15500Ala |
| | | | Trire2:123786:c.46472T > C | p.Ile15491Thr |
| | | | Trire2:123786:c.46444A > G | p.Lys15482Glu |
| | | | Trire2:123786:c.46442C > T | p.Thr15481Ile |
| | | | Trire2:123786:c.46430C > T | p.Thr15477Ile |
| | | | Trire2:123786:c.46360G > A | p.Val15454Ile |
| | | | Trire2:123786:c.46312C > A | p.Leu15438Ile |
| | | | Trire2:123786:c.46311T > G | p.Asp15437Glu |
| | | | Trire2:123786:c.46287G > T | p.Gln15429His |
| | | | Trire2:123786:c.46255G > A | p.Val15419Met |
| | | | Trire2:123786:c.46241G > A | p.Ser15414Asn |
| | | | Trire2:123786:c.46172A > G | p.Glu15391Gly |
| | | | Trire2:123786:c.46006C > A | p.Leu15336Ile |
| | | | Trire2:123786:c.46003G > A | p.Ala15335Thr |
| | | | Trire2:123786:c.45407C > T | p.Thr15136Ile |
| | | | Trire2:123786:c.45385G > A | p.Val15129Ile |
| | | | Trire2:123786:c.45302A > G | p.Gln15101Arg |
| | | | Trire2:123786:c.45061G > A | p.Ala15021Thr |
| | | | Trire2:123786:c.45001T > A | p.Tyr15001Asn |
| | | | Trire2:123786:c.45000C > G | p.Asn15000Lys |
| | | | Trire2:123786:c.44836G > C | p.Glu14946Gln |
| | | | Trire2:123786:c.44827A > C | p.Met14943Leu |
| | | | Trire2:123786:c.44824C > G | p.Pro14942Ala |
| | | | Trire2:123786:c.44744T > C | p.Val14915Ala |
| | | | Trire2:123786:c.44634T > G | p.Asp14878Glu |
| | | | Trire2:123786:c.44607G > T | p.Gln14869His |
| | | | Trire2:123786:c.44582A > G | p.Gln14861Arg |
| | | | Trire2:123786:c.44567G > A | p.Arg14856Gln |
| | | | Trire2:123786:c.44315G > A | p.Arg14772Lys |
| | | | Trire2:123786:c.43766C > T | p.Pro14589Leu |
| | | | Trire2:123786:c.43339G > A | p.Glu14447Lys |
| | | | Trire2:123786:c.43315A > G | p.Thr14439Ala |
| | | | Trire2:123786:c.43201G > A | p.Glu14401Lys |
| | | | Trire2:123786:c.43188G > T | p.Glu14396Asp |
| | | | Trire2:123786:c.43111G > T | p.Val14371Leu |
| | | | Trire2:123786:c.43090A > G | p.Asn14364Asp |
| | | | Trire2:123786:c.43064G > A | p.Arg14355Gln |
| | | | Trire2:123786:c.42932C > A | p.Ala14311Glu |
| | | | Trire2:123786:c.42762T > G | p.Ile14254Met |
| | | | Trire2:123786:c.42756A > C | p.Gln14252His |
| | | | Trire2:123786:c.42617G > C | p.Ser14206Thr |
| | | | Trire2:123786:c.42568A > G | p.Ile14190Val |
| | | | Trire2:123786:c.42481A > T | p.Thr14161Ser |
| | | | Trire2:123786:c.42311A > G | p.Lys14104Arg |
| | | | Trire2:123786:c.42259A > G | p.Asn14087Asp |
| | | | Trire2:123786:c.42176C > T | p.Ser14059Leu |
| | | | Trire2:123786:c.42174G > C | p.Glu14058Asp |
| | | | Trire2:123786:c.42151C > T | p.Pro14051Ser |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
| --- | --- | --- | --- | --- |
| | | | Trire2:123786:c.42134G > A | p.Arg14045His |
| | | | Trire2:123786:c.42041G > A | p.Arg14014Lys |
| | | | Trire2:123786:c.41911A > G | p.Thr13971Ala |
| | | | Trire2:123786:c.41909G > A | p.Arg13970Gln |
| | | | Trire2:123786:c.41887T > A | p.Leu13963Met |
| | | | Trire2:123786:c.41816C > G | p.Ser13939Cys |
| | | | Trire2:123786:c.41807C > A | p.Pro13936Gln |
| | | | Trire2:123786:c.41804A > G | p.Glu13935Gly |
| | | | Trire2:123786:c.41798G > A | p.Gly13933Asp |
| | | | Trire2:123786:c.41789G > T | p.Ser13930Ile |
| | | | Trire2:123786:c.41585A > G | p.Gln13862Arg |
| | | | Trire2:123786:c.41546T > C | p.Leu13849Ser |
| | | | Trire2:123786:c.41498C > A | p.Thr13833Lys |
| | | | Trire2:123786:c.41401A > G | p.Ile13801Val |
| | | | Trire2:123786:c.41320A > G | p.Thr13774Ala |
| | | | Trire2:123786:c.41216T > C | p.Ile13739Thr |
| | | | Trire2:123786:c.41198A > G | p.Asn13733Ser |
| | | | Trire2:123786:c.41113G > A | p.Asp13705Asn |
| | | | Trire2:123786:c.41038G > C | p.Glu13680Gln |
| | | | Trire2:123786:c.40626T > A | p.Asp13542Glu |
| | | | Trire2:123786:c.40385G > A | p.Gly13462Asp |
| | | | Trire2:123786:c.40384G > A | p.Gly13462Ser |
| | | | Trire2:123786:c.40375G > A | p.Ala13459Thr |
| | | | Trire2:123786:c.40369G > A | p.Glu13457Lys |
| | | | Trire2:123786:c.40358A > G | p.Gln13453Arg |
| | | | Trire2:123786:c.40309A > G | p.Ile13437Val |
| | | | Trire2:123786:c.40294G > A | p.Glu13432Lys |
| | | | Trire2:123786:c.40246T > G | p.Phe13416Val |
| | | | Trire2:123786:c.40129G > A | p.Val13377Ile |
| | | | Trire2:123786:c.40093A > T | p.Thr13365Ser |
| | | | Trire2:123786:c.40030G > A | p.Ala13344Thr |
| | | | Trire2:123786:c.39926C > T | p.Thr13309Ile |
| | | | Trire2:123786:c.39685G > A | p.Gly13229Arg |
| | | | Trire2:123786:c.39683A > C | p.Asp13228Ala |
| | | | Trire2:123786:c.39634G > A | p.Gly13212Ser |
| | | | Trire2:123786:c.39628A > G | p.Asn13210Asp |
| | | | Trire2:123786:c.39564C > A | p.Asp13188Glu |
| | | | Trire2:123786:c.39501C > G | p.Ser13167Arg |
| | | | Trire2:123786:c.39483A > T | p.Glu13161Asp |
| | | | Trire2:123786:c.39469A > G | p.Lys13157Glu |
| | | | Trire2:123786:c.39460C > T | p.Pro13154Ser |
| | | | Trire2:123786:c.39448G > A | p.Asp13150Asn |
| | | | Trire2:123786:c.39313C > G | p.Leu13105Val |
| | | | Trire2:123786:c.39158G > A | p.Arg13053Lys |
| | | | Trire2:123786:c.39134A > G | p.Glu13045Gly |
| | | | Trire2:123786:c.39073G > C | p.Glu13025Gln |
| | | | Trire2:123786:c.39047A > C | p.Glu13016Ala |
| | | | Trire2:123786:c.39034A > G | p.Ile13012Val |
| | | | Trire2:123786:c.38977G > C | p.Glu12993Gln |
| | | | Trire2:123786:c.38893C > T | p.Arg12965Trp |
| | | | Trire2:123786:c.38860A > G | p.Thr12954Ala |
| | | | Trire2:123786:c.38753G > A | p.Ser12918Asn |
| | | | Trire2:123786:c.38749G > A | p.Val12917Ile |
| | | | Trire2:123786:c.38635G > A | p.Val12879Ile |
| | | | Trire2:123786:c.38633C > T | p.Ala12878Val |
| | | | Trire2:123786:c.38596G > C | p.Ala12866Pro |
| | | | Trire2:123786:c.38488A > G | p.Ile12830Val |
| | | | Trire2:123786:c.38425G > T | p.Ala12809Ser |
| | | | Trire2:123786:c.38230A > G | p.Ser12744Gly |
| | | | Trire2:123786:c.38168A > G | p.Lys12723Arg |
| | | | Trire2:123786:c.38149G > A | p.Ala12717Thr |
| | | | Trire2:123786:c.38143G > A | p.Val12715Ile |
| | | | Trire2:123786:c.38059A > G | p.Ile12687Val |
| | | | Trire2:123786:c.38039C > T | p.Ser12680Leu |
| | | | Trire2:123786:c.38029G > T | p.Val12677Phe |
| | | | Trire2:123786:c.38017G > A | p.Gly12673Ser |
| | | | Trire2:123786:c.37990T > A | p.Ser12664Thr |
| | | | Trire2:123786:c.37982G > A | p.Gly12661Asp |
| | | | Trire2:123786:c.37952A > G | p.His12651Arg |
| | | | Trire2:123786:c.37945G > A | p.Glu12649Lys |
| | | | Trire2:123786:c.37919A > G | p.Glu12640Gly |
| | | | Trire2:123786:c.37774A > G | p.Met12592Val |

TABLE 3-continued

List of genes identified by repeated back crossings and sequencing and comparison with corresponding genes in QM6a as outlined above. The coding region change/amino acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.37742C > G | p.Ala12581Gly |
| | | | Trire2:123786:c.37571G > A | p.Arg12524Lys |
| | | | Trire2:123786:c.37555G > T | p.Ala12519Ser |
| | | | Trire2:123786:c.37382A > C | p.Asn12461Thr |
| | | | Trire2:123786:c.37357G > A | p.Glu12453Lys |
| | | | Trire2:123786:c.37297A > C | p.Met12433Leu |
| | | | Trire2:123786:c.37015A > C | p.Thr12339Pro |
| | | | Trire2:123786:c.36992T > C | p.Val12331Ala |
| | | | Trire2:123786:c.36982C > G | p.Gln12328Glu |
| | | | Trire2:123786:c.36856T > C | p.Tyr12286His |
| | | | Trire2:123786:c.36814G > T | p.Ala12272Ser |
| | | | Trire2:123786:c.36811A > G | p.Lys12271Glu |
| | | | Trire2:123786:c.36770C > T | p.Ala12257Val |
| | | | Trire2:123786:c.36742C > T | p.Leu12248Phe |
| | | | Trire2:123786:c.36736A > C | p.Lys12246Gln |
| | | | Trire2:123786:c.36711C > A | p.Asp12237Glu |
| | | | Trire2:123786:c.36688T > C | p.Cys12230Arg |
| | | | Trire2:123786:c.36660T > G | p.Ile12220Met |
| | | | Trire2:123786:c.36646C > T | p.Pro12216Ser |
| | | | Trire2:123786:c.36638G > A | p.Arg12213Lys |
| | | | Trire2:123786:c.36630G > C | p.Lys12210Asn |
| | | | Trire2:123786:c.36626A > G | p.Glu12209Gly |
| | | | Trire2:123786:c.36625G > A | p.Glu12209Lys |
| | | | Trire2:123786:c.36616A > G | p.Lys12206Glu |
| | | | Trire2:123786:c.36496G > A | p.Val12166Ile |
| | | | Trire2:123786:c.36478T > C | p.Phe12160Leu |
| | | | Trire2:123786:c.36409T > A | p.Leu12137Met |
| | | | Trire2:123786:c.36392C > T | p.Ser12131Leu |
| | | | Trire2:123786:c.36374A > T | p.Gln12125Leu |
| | | | Trire2:123786:c.36373C > T | p.Gln12125* |
| | | | Trire2:123786:c.36361C > A | p.His12121Asn |
| | | | Trire2:123786:c.36355G > A | p.Gly12119Ser |
| | | | Trire2:123786:c.36328G > A | p.Val12110Ile |
| | | | Trire2:123786:c.36191G > A | p.Arg12064Gln |
| | | | Trire2:123786:c.35994T > G | p.Asn11998Lys |
| | | | Trire2:123786:c.35885A > G | p.Asn11962Ser |
| | | | Trire2:123786:c.35878A > G | p.Thr11960Ala |
| | | | Trire2:123786:c.35816C > A | p.Pro11939Gln |
| | | | Trire2:123786:c.35799G > A | p.Met11933Ile |
| | | | Trire2:123786:c.35706G > A | p.Met11902Ile |
| | | | Trire2:123786:c.35705T > A | p.Met11902Lys |
| | | | Trire2:123786:c.35698A > G | p.Ile11900Val |
| | | | Trire2:123786:c.35687G > A | p.Ser11896Asn |
| | | | Trire2:123786:c.35653G > T | p.Gly11885Cys |
| | | | Trire2:123786:c.35613A > C | p.Glu11871Asp |
| | | | Trire2:123786:c.35603C > A | p.Ala11868Glu |
| | | | Trire2:123786:c.35567G > A | p.Ser11856Asn |
| | | | Trire2:123786:c.35563G > A | p.Gly11855Arg |
| | | | Trire2:123786:c.35559G > T | p.Met11853Ile |
| | | | Trire2:123786:c.35520G > C | p.Met11840Ile |
| | | | Trire2:123786:c.35519T > C | p.Met11840Thr |
| | | | Trire2:123786:c.35503T > A | p.Ser11835Thr |
| | | | Trire2:123786:c.35492T > C | p.Leu11831Ser |
| | | | Trire2:123786:c.35480C > G | p.Thr11827Ser |
| | | | Trire2:123786:c.35432A > G | p.Lys11811Arg |
| | | | Trire2:123786:c.35349T > A | p.Asn11783Lys |
| | | | Trire2:123786:c.35348A > G | p.Asn11783Ser |
| | | | Trire2:123786:c.35337T > A | p.Asp11779Glu |
| | | | Trire2:123786:c.35321T > C | p.Leu11774Ser |
| | | | Trire2:123786:c.35270A > C | p.Gln11757Pro |
| | | | Trire2:123786:c.35261G > A | p.Arg11754Lys |
| | | | Trire2:123786:c.35260A > G | p.Arg11754Gly |
| | | | Trire2:123786:c.35184C > G | p.Asn11728Lys |
| | | | Trire2:123786:c.35148C > G | p.Ile11716Met |
| | | | Trire2:123786:c.35051A > G | p.Lys11684Arg |
| | | | Trire2:123786:c.34845A > T | p.Arg11615Ser |
| | | | Trire2:123786:c.34826G > C | p.Arg11609Pro |
| | | | Trire2:123786:c.34793C > T | p.Ser11598Leu |
| | | | Trire2:123786:c.34760G > A | p.Gly11587Glu |
| | | | Trire2:123786:c.34732C > T | p.Leu11578Phe |
| | | | Trire2:123786:c.34724G > C | p.Gly11575Ala |
| | | | Trire2:123786:c.34573T > C | p.Ser11525Pro |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.34492C > T | p.Pro11498Ser |
| | | | Trire2:123786:c.34464G > T | p.Glu11488Asp |
| | | | Trire2:123786:c.34424C > T | p.Ala11475Val |
| | | | Trire2:123786:c.34316C > A | p.Ala11439Asp |
| | | | Trire2:123786:c.34297G > T | p.Val11433Leu |
| | | | Trire2:123786:c.34189C > A | p.Leu11397Ile |
| | | | Trire2:123786:c.34109A > G | p.Lys11370Arg |
| | | | Trire2:123786:c.33967T > C | p.Ser11323Pro |
| | | | Trire2:123786:c.33949A > G | p.Thr11317Ala |
| | | | Trire2:123786:c.33922C > T | p.Leu11308Phe |
| | | | Trire2:123786:c.33904G > A | p.Val11302Ile |
| | | | Trire2:123786:c.33862A > G | p.Ile11288Val |
| | | | Trire2:123786:c.33853C > G | p.Pro11285Ala |
| | | | Trire2:123786:c.33830C > G | p.Pro11277Arg |
| | | | Trire2:123786:c.33814T > C | p.Ser11272Pro |
| | | | Trire2:123786:c.33806G > A | p.Arg11269His |
| | | | Trire2:123786:c.33761C > A | p.Thr11254Lys |
| | | | Trire2:123786:c.33749C > G | p.Ala11250Gly |
| | | | Trire2:123786:c.33739G > A | p.Glu11247Lys |
| | | | Trire2:123786:c.33695T > A | p.Leu11232His |
| | | | Trire2:123786:c.33687G > C | p.Gln11229His |
| | | | Trire2:123786:c.33674C > A | p.Ala11225Glu |
| | | | Trire2:123786:c.33568T > C | p.Phe11190Leu |
| | | | Trire2:123786:c.33563G > A | p.Gly11188Asp |
| | | | Trire2:123786:c.33562G > A | p.Gly11188Ser |
| | | | Trire2:123786:c.33545G > C | p.Ser11182Thr |
| | | | Trire2:123786:c.33403A > G | p.Ile11135Val |
| | | | Trire2:123786:c.33373T > A | p.Leu11125Ile |
| | | | Trire2:123786:c.33366A > T | p.Glu11122Asp |
| | | | Trire2:123786:c.33341T > C | p.Leu11114Ser |
| | | | Trire2:123786:c.33331G > A | p.Glu11111Lys |
| | | | Trire2:123786:c.33320G > C | p.Gly11107Ala |
| | | | Trire2:123786:c.33311C > T | p.Ser11104Leu |
| | | | Trire2:123786:c.33277G > A | p.Glu11093Lys |
| | | | Trire2:123786:c.33235G > A | p.Asp11079Asn |
| | | | Trire2:123786:c.33211A > G | p.Lys11071Glu |
| | | | Trire2:123786:c.33206G > A | p.Gly11069Asp |
| | | | Trire2:123786:c.33141A > C | p.Glu11047Asp |
| | | | Trire2:123786:c.33122C > T | p.Ser11041Phe |
| | | | Trire2:123786:c.33121T > G | p.Ser11041Ala |
| | | | Trire2:123786:c.32968G > A | p.Gly10990Ser |
| | | | Trire2:123786:c.32936C > T | p.Pro10979Leu |
| | | | Trire2:123786:c.32891T > C | p.Val10964Ala |
| | | | Trire2:123786:c.32833A > G | p.Ile10945Val |
| | | | Trire2:123786:c.32696T > C | p.Val10899Ala |
| | | | Trire2:123786:c.32693T > C | p.Val10898Ala |
| | | | Trire2:123786:c.32672T > C | p.Leu10891Pro |
| | | | Trire2:123786:c.32664G > C | p.Leu10888Phe |
| | | | Trire2:123786:c.32608G > A | p.Glu10870Lys |
| | | | Trire2:123786:c.32601A > G | p.Ile10867Met |
| | | | Trire2:123786:c.32584C > A | p.Gln10862Lys |
| | | | Trire2:123786:c.32546T > A | p.Leu10849His |
| | | | Trire2:123786:c.32450G > A | p.Arg10817Gln |
| | | | Trire2:123786:c.32437G > C | p.Glu10813Gln |
| | | | Trire2:123786:c.32397A > C | p.Lys10799Asn |
| | | | Trire2:123786:c.32323A > G | p.Asn10775Asp |
| | | | Trire2:123786:c.32218G > A | p.Val10740Met |
| | | | Trire2:123786:c.32094C > A | p.Asp10698Glu |
| | | | Trire2:123786:c.32013G > T | p.Glu10671Asp |
| | | | Trire2:123786:c.31997T > C | p.Leu10666Ser |
| | | | Trire2:123786:c.31924G > A | p.Asp10642Asn |
| | | | Trire2:123786:c.31833T > G | p.Asp10611Glu |
| | | | Trire2:123786:c.31813A > G | p.Ile10605Val |
| | | | Trire2:123786:c.31741G > A | p.Ala10581Thr |
| | | | Trire2:123786:c.31573G > A | p.Val10525Ile |
| | | | Trire2:123786:c.31484C > T | p.Thr10495Ile |
| | | | Trire2:123786:c.31412G > A | p.Arg10471Gln |
| | | | Trire2:123786:c.31408A > G | p.Thr10470Ala |
| | | | Trire2:123786:c.31282C > A | p.Pro10428Thr |
| | | | Trire2:123786:c.31280G > A | p.Arg10427Gln |
| | | | Trire2:123786:c.31093C > A | p.Leu10365Ile |
| | | | Trire2:123786:c.31084C > T | p.Pro10362Ser |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.30853G > T | p.Ala10285Ser |
| | | | Trire2:123786:c.30552T > G | p.Asp10184Glu |
| | | | Trire2:123786:c.30536C > T | p.Ala10179Val |
| | | | Trire2:123786:c.30509G > A | p.Gly10170Glu |
| | | | Trire2:123786:c.30340G > A | p.Val10114Ile |
| | | | Trire2:123786:c.30321T > G | p.Asp10107Glu |
| | | | Trire2:123786:c.30319G > C | p.Asp10107His |
| | | | Trire2:123786:c.30290C > T | p.Ala10097Val |
| | | | Trire2:123786:c.30289G > A | p.Ala10097Thr |
| | | | Trire2:123786:c.30282A > C | p.Lys10094Asn |
| | | | Trire2:123786:c.30135A > T | p.Glu10045Asp |
| | | | Trire2:123786:c.30100A > C | p.Met10034Leu |
| | | | Trire2:123786:c.30036C > G | p.Asp10012Glu |
| | | | Trire2:123786:c.29989G > T | p.Ala9997Ser |
| | | | Trire2:123786:c.29985G > C | p.Glu9995Asp |
| | | | Trire2:123786:c.29870G > T | p.Gly9957Val |
| | | | Trire2:123786:c.29863C > A | p.Pro9955Thr |
| | | | Trire2:123786:c.29782A > C | p.Asn9928His |
| | | | Trire2:123786:c.29692C > T | p.Leu9898Phe |
| | | | Trire2:123786:c.29654T > C | p.Val9885Ala |
| | | | Trire2:123786:c.29636A > C | p.Gln9879Pro |
| | | | Trire2:123786:c.29560G > A | p.Val9854Ile |
| | | | Trire2:123786:c.29405C > T | p.Thr9802Ile |
| | | | Trire2:123786:c.29399T > A | p.Phe9800Tyr |
| | | | Trire2:123786:c.29332C > T | p.Pro9778Ser |
| | | | Trire2:123786:c.29225A > G | p.Asp9742Gly |
| | | | Trire2:123786:c.29191G > C | p.Ala9731Pro |
| | | | Trire2:123786:c.29120G > A | p.Arg9707Gln |
| | | | Trire2:123786:c.29111A > G | p.Asn9704Ser |
| | | | Trire2:123786:c.29080G > A | p.Glu9694Lys |
| | | | Trire2:123786:c.29023A > G | p.Asn9675Asp |
| | | | Trire2:123786:c.28988G > A | p.Arg9663Lys |
| | | | Trire2:123786:c.28856A > G | p.Lys9619Arg |
| | | | Trire2:123786:c.28813A > C | p.Thr9605Pro |
| | | | Trire2:123786:c.28791T > A | p.His9597Gln |
| | | | Trire2:123786:c.28657A > C | p.Ile9553Leu |
| | | | Trire2:123786:c.28574A > G | p.Gln9525Arg |
| | | | Trire2:123786:c.28555G > A | p.Glu9519Lys |
| | | | Trire2:123786:c.28531A > G | p.Ser9511Gly |
| | | | Trire2:123786:c.28498G > A | p.Asp9500Asn |
| | | | Trire2:123786:c.28483A > C | p.Met9495Leu |
| | | | Trire2:123786:c.28393A > T | p.Thr9465Ser |
| | | | Trire2:123786:c.28340A > G | p.Asp9447Gly |
| | | | Trire2:123786:c.28328C > T | p.Ala9443Val |
| | | | Trire2:123786:c.28316G > A | p.Gly9439Asp |
| | | | Trire2:123786:c.28301T > A | p.Leu9434Gln |
| | | | Trire2:123786:c.28268G > A | p.Ser9423Asn |
| | | | Trire2:123786:c.28194C > G | p.Asp9398Glu |
| | | | Trire2:123786:c.28188T > G | p.Ile9396Met |
| | | | Trire2:123786:c.28084G > A | p.Gly9362Ser |
| | | | Trire2:123786:c.28052A > G | p.Lys9351Arg |
| | | | Trire2:123786:c.28028G > A | p.Arg9343Gln |
| | | | Trire2:123786:c.27827T > C | p.Val9276Ala |
| | | | Trire2:123786:c.27626A > G | p.Lys9209Arg |
| | | | Trire2:123786:c.27623C > T | p.Thr9208Met |
| | | | Trire2:123786:c.27358A > C | p.Asn9120His |
| | | | Trire2:123786:c.27314T > G | p.Val9105Gly |
| | | | Trire2:123786:c.27265C > G | p.Leu9089Val |
| | | | Trire2:123786:c.27229T > A | p.Ser9077Thr |
| | | | Trire2:123786:c.27115G > A | p.Val9039Ile |
| | | | Trire2:123786:c.27096A > T | p.Glu9032Asp |
| | | | Trire2:123786:c.26957C > T | p.Ala8986Val |
| | | | Trire2:123786:c.26929A > C | p.Lys8977Gln |
| | | | Trire2:123786:c.26881G > A | p.Val8961Ile |
| | | | Trire2:123786:c.26773A > G | p.Ile8925Val |
| | | | Trire2:123786:c.26618G > A | p.Gly8873Asp |
| | | | Trire2:123786:c.26536G > A | p.Asp8846Asn |
| | | | Trire2:123786:c.26483T > C | p.Met8828Thr |
| | | | Trire2:123786:c.26466C > G | p.Asp8822Glu |
| | | | Trire2:123786:c.26443C > T | p.Pro8815Ser |
| | | | Trire2:123786:c.26438G > T | p.Gly8813Val |
| | | | Trire2:123786:c.26413G > A | p.Val8805Ile |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.26311T > A | p.Cys8771Ser |
| | | | Trire2:123786:c.26108C > A | p.Ala8703Glu |
| | | | Trire2:123786:c.26099C > T | p.Ser8700Leu |
| | | | Trire2:123786:c.26028T > G | p.Asp8676Glu |
| | | | Trire2:123786:c.25958G > A | p.Arg8653His |
| | | | Trire2:123786:c.25847C > T | p.Ser8616Phe |
| | | | Trire2:123786:c.25845G > T | p.Glu8615Asp |
| | | | Trire2:123786:c.25761G > C | p.Glu8587Asp |
| | | | Trire2:123786:c.25582T > C | p.Cys8528Arg |
| | | | Trire2:123786:c.25549T > A | p.Leu8517Met |
| | | | Trire2:123786:c.25532T > C | p.Met8511Thr |
| | | | Trire2:123786:c.25270A > T | p.Thr8424Ser |
| | | | Trire2:123786:c.25253C > G | p.Thr8418Ser |
| | | | Trire2:123786:c.25100G > A | p.Gly8367Asp |
| | | | Trire2:123786:c.25091T > A | p.Leu8364His |
| | | | Trire2:123786:c.25083G > C | p.Leu8361Phe |
| | | | Trire2:123786:c.25071A > T | p.Gln8357His |
| | | | Trire2:123786:c.25064C > T | p.Ala8355Val |
| | | | Trire2:123786:c.25057A > G | p.Asn8353Asp |
| | | | Trire2:123786:c.25013G > C | p.Gly8338Ala |
| | | | Trire2:123786:c.24919C > T | p.Arg8307Cys |
| | | | Trire2:123786:c.24868A > G | p.Ile8290Val |
| | | | Trire2:123786:c.24817A > G | p.Ile8273Val |
| | | | Trire2:123786:c.24805C > T | p.Pro8269Ser |
| | | | Trire2:123786:c.24740T > C | p.Val8247Ala |
| | | | Trire2:123786:c.24733T > C | p.Tyr8245His |
| | | | Trire2:123786:c.24708C > A | p.Asp8236Glu |
| | | | Trire2:123786:c.24698C > T | p.Ala8233Val |
| | | | Trire2:123786:c.24640G > A | p.Val8214Ile |
| | | | Trire2:123786:c.24560G > T | p.Arg8187Met |
| | | | Trire2:123786:c.24485A > T | p.Tyr8162Phe |
| | | | Trire2:123786:c.24454G > A | p.Val8152Ile |
| | | | Trire2:123786:c.24415G > A | p.Val8139Ile |
| | | | Trire2:123786:c.24406T > G | p.Cys8136Gly |
| | | | Trire2:123786:c.24399C > G | p.Asp8133Glu |
| | | | Trire2:123786:c.24242G > C | p.Cys8081Ser |
| | | | Trire2:123786:c.24202T > A | p.Ser8068Thr |
| | | | Trire2:123786:c.24196G > A | p.Asp8066Asn |
| | | | Trire2:123786:c.24190C > T | p.Leu8064Phe |
| | | | Trire2:123786:c.24182A > G | p.Asn8061Ser |
| | | | Trire2:123786:c.24146G > T | p.Gly8049Val |
| | | | Trire2:123786:c.24044T > C | p.Leu8015Pro |
| | | | Trire2:123786:c.24037G > A | p.Asp8013Asn |
| | | | Trire2:123786:c.24031A > G | p.Thr8011Ala |
| | | | Trire2:123786:c.23797G > A | p.Val7933Ile |
| | | | Trire2:123786:c.23635C > T | p.Arg7879* |
| | | | Trire2:123786:c.23600C > T | p.Ala7867Val |
| | | | Trire2:123786:c.23592C > A | p.Asp7864Glu |
| | | | Trire2:123786:c.23591A > G | p.Asp7864Gly |
| | | | Trire2:123786:c.23545A > G | p.Asn7849Asp |
| | | | Trire2:123786:c.23525A > C | p.Glu7842Ala |
| | | | Trire2:123786:c.23183G > A | p.Arg7728Gln |
| | | | Trire2:123786:c.23164T > C | p.Ser7722Pro |
| | | | Trire2:123786:c.23092C > T | p.Pro7698Ser |
| | | | Trire2:123786:c.22976G > A | p.Ser7659Asn |
| | | | Trire2:123786:c.22948A > T | p.Thr7650Ser |
| | | | Trire2:123786:c.22919A > G | p.Glu7640Gly |
| | | | Trire2:123786:c.22822G > A | p.Gly7608Ser |
| | | | Trire2:123786:c.22772T > C | p.Leu7591Ser |
| | | | Trire2:123786:c.22771T > G | p.Leu7591Val |
| | | | Trire2:123786:c.22766C > A | p.Thr7589Asn |
| | | | Trire2:123786:c.22594A > T | p.Met7532Leu |
| | | | Trire2:123786:c.22591A > G | p.Thr7531Ala |
| | | | Trire2:123786:c.22560A > C | p.Arg7520Ser |
| | | | Trire2:123786:c.22552G > A | p.Val7518Ile |
| | | | Trire2:123786:c.22531A > G | p.Asn7511Asp |
| | | | Trire2:123786:c.22297G > A | p.Gly7433Arg |
| | | | Trire2:123786:c.22285A > G | p.Lys7429Glu |
| | | | Trire2:123786:c.22267G > A | p.Val7423Ile |
| | | | Trire2:123786:c.22224C > A | p.Asp7408Glu |
| | | | Trire2:123786:c.22153C > T | p.Pro7385Ser |
| | | | Trire2:123786:c.22133T > A | p.Ile7378Lys |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.22016T > C | p.Leu7339Ser |
| | | | Trire2:123786:c.21961A > G | p.Thr7321Ala |
| | | | Trire2:123786:c.21845T > A | p.Leu7282His |
| | | | Trire2:123786:c.21776C > A | p.Ala7259Glu |
| | | | Trire2:123786:c.21500T > A | p.Val7167Asp |
| | | | Trire2:123786:c.21306A > C | p.Lys7102Asn |
| | | | Trire2:123786:c.20936A > C | p.Lys6979Thr |
| | | | Trire2:123786:c.20807C > T | p.Pro6936Leu |
| | | | Trire2:123786:c.20803A > G | p.Ile6935Val |
| | | | Trire2:123786:c.20756G > C | p.Ser6919Thr |
| | | | Trire2:123786:c.20752G > C | p.Ala6918Pro |
| | | | Trire2:123786:c.20434G > A | p.Val6812Ile |
| | | | Trire2:123786:c.20098G > A | p.Val6700Ile |
| | | | Trire2:123786:c.20051C > T | p.Thr6684Met |
| | | | Trire2:123786:c.19957T > C | p.Ser6653Pro |
| | | | Trire2:123786:c.19916G > A | p.Cys6639Tyr |
| | | | Trire2:123786:c.19772G > A | p.Arg6591Gln |
| | | | Trire2:123786:c.19697A > G | p.Asp6566Gly |
| | | | Trire2:123786:c.19670C > T | p.Thr6557Ile |
| | | | Trire2:123786:c.19627T > A | p.Ser6543Thr |
| | | | Trire2:123786:c.19625A > G | p.His6542Arg |
| | | | Trire2:123786:c.19602C > A | p.Asn6534Lys |
| | | | Trire2:123786:c.19529C > A | p.Pro6510His |
| | | | Trire2:123786:c.19525T > C | p.Ser6509Pro |
| | | | Trire2:123786:c.19504G > A | p.Val6502Ile |
| | | | Trire2:123786:c.19414A > G | p.Asn6472Asp |
| | | | Trire2:123786:c.19408A > G | p.Lys6470Glu |
| | | | Trire2:123786:c.19217C > A | p.Thr6406Lys |
| | | | Trire2:123786:c.19186C > T | p.Pro6396Ser |
| | | | Trire2:123786:c.19088C > T | p.Ala6363Val |
| | | | Trire2:123786:c.19040A > G | p.Lys6347Arg |
| | | | Trire2:123786:c.19033A > G | p.Ile6345Val |
| | | | Trire2:123786:c.19023G > T | p.Leu6341Phe |
| | | | Trire2:123786:c.18997G > C | p.Val6333Leu |
| | | | Trire2:123786:c.18968A > G | p.His6323Arg |
| | | | Trire2:123786:c.18911G > A | p.Gly6304Asp |
| | | | Trire2:123786:c.18850A > C | p.Met6284Leu |
| | | | Trire2:123786:c.18654A > T | p.Gln6218His |
| | | | Trire2:123786:c.18389A > G | p.Gln6130Arg |
| | | | Trire2:123786:c.18238G > A | p.Gly6080Ser |
| | | | Trire2:123786:c.18166T > C | p.Ser6056Pro |
| | | | Trire2:123786:c.18052G > C | p.Gly6018Arg |
| | | | Trire2:123786:c.17972A > C | p.Lys5991Thr |
| | | | Trire2:123786:c.17920G > A | p.Val5974Ile |
| | | | Trire2:123786:c.17693T > A | p.Leu5898Gln |
| | | | Trire2:123786:c.17554A > G | p.Thr5852Ala |
| | | | Trire2:123786:c.17503C > T | p.Pro5835Ser |
| | | | Trire2:123786:c.17498A > G | p.Asp5833Gly |
| | | | Trire2:123786:c.17368C > G | p.Leu5790Val |
| | | | Trire2:123786:c.17317A > T | p.Ile5773Leu |
| | | | Trire2:123786:c.17253C > G | p.Ser5751Arg |
| | | | Trire2:123786:c.17234C > A | p.Thr5745Asn |
| | | | Trire2:123786:c.17143C > T | p.Pro5715Ser |
| | | | Trire2:123786:c.17141T > C | p.Leu5714Pro |
| | | | Trire2:123786:c.17120G > C | p.Arg5707Thr |
| | | | Trire2:123786:c.17095A > G | p.Ser5699Gly |
| | | | Trire2:123786:c.17047G > A | p.Val5683Ile |
| | | | Trire2:123786:c.17002G > A | p.Ala5668Thr |
| | | | Trire2:123786:c.16993G > C | p.Gly5665Arg |
| | | | Trire2:123786:c.16964A > G | p.Asn5655Ser |
| | | | Trire2:123786:c.16857G > T | p.Glu5619Asp |
| | | | Trire2:123786:c.16837T > C | p.Ser5613Pro |
| | | | Trire2:123786:c.16816C > T | p.Leu5606Phe |
| | | | Trire2:123786:c.16802G > A | p.Ser5601Asn |
| | | | Trire2:123786:c.16751A > T | p.Tyr5584Phe |
| | | | Trire2:123786:c.16741T > C | p.Tyr5581His |
| | | | Trire2:123786:c.16708G > A | p.Gly5570Ser |
| | | | Trire2:123786:c.16698A > C | p.Glu5566Asp |
| | | | Trire2:123786:c.16688A > G | p.Lys5563Arg |
| | | | Trire2:123786:c.16666G > A | p.Val5556Ile |
| | | | Trire2:123786:c.16487T > G | p.Val5496Gly |
| | | | Trire2:123786:c.16486G > C | p.Val5496Leu |

TABLE 3-continued

List of genes identified by repeated back crossings and sequencing and comparison
with corresponding genes in QM6a as outlined above. The coding region change/amino
acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.16447C > G | p.Gln5483Glu |
| | | | Trire2:123786:c.16444G > A | p.Gly5482Ser |
| | | | Trire2:123786:c.16210G > A | p.Val5404Ile |
| | | | Trire2:123786:c.16146A > C | p.Gln5382His |
| | | | Trire2:123786:c.16033A > G | p.Ile5345Val |
| | | | Trire2:123786:c.15964G > A | p.Val5322Ile |
| | | | Trire2:123786:c.15959G > C | p.Ser5320Thr |
| | | | Trire2:123786:c.15821A > G | p.Gln5274Arg |
| | | | Trire2:123786:c.15818T > A | p.Met5273Lys |
| | | | Trire2:123786:c.15794C > A | p.Pro5265Gln |
| | | | Trire2:123786:c.15763A > C | p.Asn5255His |
| | | | Trire2:123786:c.15760G > A | p.Asp5254Asn |
| | | | Trire2:123786:c.15642C > A | p.His5214Gln |
| | | | Trire2:123786:c.15622G > C | p.Asp5208His |
| | | | Trire2:123786:c.15582T > A | p.Asp5194Glu |
| | | | Trire2:123786:c.15313G > A | p.Val5105Ile |
| | | | Trire2:123786:c.15308T > C | p.Val5103Ala |
| | | | Trire2:123786:c.15203C > A | p.Ser5068Tyr |
| | | | Trire2:123786:c.15179A > T | p.Gln5060Leu |
| | | | Trire2:123786:c.15061C > T | p.Pro5021Ser |
| | | | Trire2:123786:c.14984G > C | p.Cys4995Ser |
| | | | Trire2:123786:c.14606G > A | p.Ser4869Asn |
| | | | Trire2:123786:c.14449G > C | p.Gly4817Arg |
| | | | Trire2:123786:c.14309A > T | p.Gln4770Leu |
| | | | Trire2:123786:c.14242C > T | p.Pro4748Ser |
| | | | Trire2:123786:c.14204T > C | p.Ile4735Thr |
| | | | Trire2:123786:c.14042C > T | p.Pro4681Leu |
| | | | Trire2:123786:c.14035A > G | p.Ile4679Val |
| | | | Trire2:123786:c.14022A > G | p.Ile4674Met |
| | | | Trire2:123786:c.13987G > A | p.Asp4663Asn |
| | | | Trire2:123786:c.13823C > T | p.Ala4608Val |
| | | | Trire2:123786:c.13585C > A | p.Gln4529Lys |
| | | | Trire2:123786:c.13457C > T | p.Ala4486Val |
| | | | Trire2:123786:c.13423G > A | p.Ala4475Thr |
| | | | Trire2:123786:c.13169A > C | p.Tyr4390Ser |
| | | | Trire2:123786:c.13146T > G | p.Asn4382Lys |
| | | | Trire2:123786:c.13145A > T | p.Asn4382Ile |
| | | | Trire2:123786:c.12686A > C | p.Glu4229Ala |
| | | | Trire2:123786:c.12307C > T | p.His4103Tyr |
| | | | Trire2:123786:c.12252T > G | p.Ser4084Arg |
| | | | Trire2:123786:c.11990A > C | p.Glu3997Ala |
| | | | Trire2:123786:c.11656A > G | p.Asn3886Asp |
| | | | Trire2:123786:c.11152G > A | p.Glu3718Lys |
| | | | Trire2:123786:c.11024G > A | p.Ser3675Asn |
| | | | Trire2:123786:c.11000C > T | p.Pro3667Leu |
| | | | Trire2:123786:c.10979G > C | p.Gly3660Ala |
| | | | Trire2:123786:c.10947G > T | p.Met3649Ile |
| | | | Trire2:123786:c.10927G > A | p.Ala3643Thr |
| | | | Trire2:123786:c.10925T > C | p.Leu3642Pro |
| | | | Trire2:123786:c.10783G > A | p.Asp3595Asn |
| | | | Trire2:123786:c.10765C > G | p.Leu3589Val |
| | | | Trire2:123786:c.10705G > A | p.Glu3569Lys |
| | | | Trire2:123786:c.10704T > G | p.Asp3568Glu |
| | | | Trire2:123786:c.10683T > G | p.Asp3561Glu |
| | | | Trire2:123786:c.10639A > G | p.Lys3547Glu |
| | | | Trire2:123786:c.10556G > A | p.Gly3519Asp |
| | | | Trire2:123786:c.10511G > A | p.Arg3504Gln |
| | | | Trire2:123786:c.10324T > G | p.Ser3442Ala |
| | | | Trire2:123786:c.10295A > T | p.Lys3432Met |
| | | | Trire2:123786:c.10284T > A | p.His3428Gln |
| | | | Trire2:123786:c.10139A > G | p.Lys3380Arg |
| | | | Trire2:123786:c.10135A > T | p.Met3379Leu |
| | | | Trire2:123786:c.10045A > G | p.Met3349Val |
| | | | Trire2:123786:c.10031A > T | p.Lys3344Met |
| | | | Trire2:123786:c.10019C > A | p.Pro3340Gln |
| | | | Trire2:123786:c.9971C > T | p.Pro3324Leu |
| | | | Trire2:123786:c.9608C > T | p.Ala3203Val |
| | | | Trire2:123786:c.9478G > A | p.Ala3160Thr |
| | | | Trire2:123786:c.9409A > G | p.Arg3137Gly |
| | | | Trire2:123786:c.9263A > G | p.Lys3088Arg |
| | | | Trire2:123786:c.9252A > C | p.Glu3084Asp |
| | | | Trire2:123786:c.9247A > G | p.Thr3083Ala |

TABLE 3-continued

List of genes identified by repeated back crossings and sequencing and comparison with corresponding genes in QM6a as outlined above. The coding region change/amino acid change in relation to a corresponding functional gene is indicated (ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.9230A > G | p.Gln3077Arg |
| | | | Trire2:123786:c.9154A > G | p.Ser3052Gly |
| | | | Trire2:123786:c.9001G > A | p.Ala3001Thr |
| | | | Trire2:123786:c.8963A > G | p.Glu2988Gly |
| | | | Trire2:123786:c.8945C > G | p.Ala2982Gly |
| | | | Trire2:123786:c.8941G > A | p.Asp2981Asn |
| | | | Trire2:123786:c.8918A > C | p.Tyr2973Ser |
| | | | Trire2:123786:c.8697A > G | p.Ile2899Met |
| | | | Trire2:123786:c.8671A > C | p.Thr2891Pro |
| | | | Trire2:123786:c.8654C > T | p.Ser2885Phe |
| | | | Trire2:123786:c.8569G > A | p.Val2857Ile |
| | | | Trire2:123786:c.8545G > A | p.Asp2849Asn |
| | | | Trire2:123786:c.8509A > G | p.Thr2837Ala |
| | | | Trire2:123786:c.8488A > C | p.Met2830Leu |
| | | | Trire2:123786:c.8354T > C | p.Ile2785Thr |
| | | | Trire2:123786:c.8347G > A | p.Val2783Ile |
| | | | Trire2:123786:c.8104T > C | p.Ser2702Pro |
| | | | Trire2:123786:c.8062C > A | p.Leu2688Ile |
| | | | Trire2:123786:c.7963G > A | p.Val2655Met |
| | | | Trire2:123786:c.7961C > T | p.Pro2654Leu |
| | | | Trire2:123786:c.7943C > A | p.Ala2648Glu |
| | | | Trire2:123786:c.7852A > G | p.Asn2618Asp |
| | | | Trire2:123786:c.7651G > T | p.Ala2551Ser |
| | | | Trire2:123786:c.7558A > G | p.Lys2520Glu |
| | | | Trire2:123786:c.7517A > G | p.Gln2506Arg |
| | | | Trire2:123786:c.7501A > G | p.Ser2501Gly |
| | | | Trire2:123786:c.7252A > G | p.Asn2418Asp |
| | | | Trire2:123786:c.7240G > C | p.Gly2414Arg |
| | | | Trire2:123786:c.7238C > G | p.Thr2413Ser |
| | | | Trire2:123786:c.7156A > G | p.Asn2386Asp |
| | | | Trire2:123786:c.6956G > A | p.Ser2319Asn |
| | | | Trire2:123786:c.6895A > G | p.Thr2299Ala |
| | | | Trire2:123786:c.6883A > T | p.Thr2295Ser |
| | | | Trire2:123786:c.6749C > G | p.Thr2250Ser |
| | | | Trire2:123786:c.6681C > G | p.Asp2227Glu |
| | | | Trire2:123786:c.6677G > A | p.Arg2226Lys |
| | | | Trire2:123786:c.6620T > C | p.Leu2207Ser |
| | | | Trire2:123786:c.6592T > C | p.Cys2198Arg |
| | | | Trire2:123786:c.6337G > A | p.Val2113Ile |
| | | | Trire2:123786:c.6295A > G | p.Thr2099Ala |
| | | | Trire2:123786:c.6221G > A | p.Gly2074Asp |
| | | | Trire2:123786:c.6196C > A | p.Gln2066Lys |
| | | | Trire2:123786:c.6142C > T | p.Pro2048Ser |
| | | | Trire2:123786:c.6119C > T | p.Ala2040Val |
| | | | Trire2:123786:c.5949A > C | p.Lys1983Asn |
| | | | Trire2:123786:c.5777A > G | p.Lys1926Arg |
| | | | Trire2:123786:c.5752A > G | p.Ile1918Val |
| | | | Trire2:123786:c.5662G > C | p.Ala1888Pro |
| | | | Trire2:123786:c.5639T > C | p.Val1880Ala |
| | | | Trire2:123786:c.5624G > A | p.Arg1875Lys |
| | | | Trire2:123786:c.5566G > A | p.Val1856Ile |
| | | | Trire2:123786:c.5542G > A | p.Val1848Ile |
| | | | Trire2:123786:c.5447T > C | p.Val1816Ala |
| | | | Trire2:123786:c.5377A > G | p.Asn1793Asp |
| | | | Trire2:123786:c.4828A > G | p.Ile1610Val |
| | | | Trire2:123786:c.4691G > A | p.Arg1564Gln |
| | | | Trire2:123786:c.4664A > G | p.Glu1555Gly |
| | | | Trire2:123786:c.4608A > C | p.Glu1536Asp |
| | | | Trire2:123786:c.4502C > T | p.Ala1501Val |
| | | | Trire2:123786:c.4415T > C | p.Leu1472Pro |
| | | | Trire2:123786:c.4403C > T | p.Ala1468Val |
| | | | Trire2:123786:c.4258T > A | p.Ser1420Thr |
| | | | Trire2:123786:c.4193C > T | p.Ser1398Leu |
| | | | Trire2:123786:c.4192T > C | p.Ser1398Pro |
| | | | Trire2:123786:c.4138C > A | p.His1380Asn |
| | | | Trire2:123786:c.4093A > G | p.Ile1365Val |
| | | | Trire2:123786:c.3988A > G | p.Thr1330Ala |
| | | | Trire2:123786:c.3938T > C | p.Val1313Ala |
| | | | Trire2:123786:c.3801T > A | p.His1267Gln |
| | | | Trire2:123786:c.3763C > T | p.Pro1255Ser |
| | | | Trire2:123786:c.3755A > G | p.Asn1252Ser |
| | | | Trire2:123786:c.3661G > A | p.Ala1221Thr |

TABLE 3-continued

List of genes identified by repeated back crossings and sequencing and comparison with corresponding genes in QM6a as outlined above. The coding region change/amino acid change in relation to a corresponding functional gene is indicated (ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.3499A > G | p.Asn1167Asp |
| | | | Trire2:123786:c.3438C > G | p.His1146Gln |
| | | | Trire2:123786:c.3283A > T | p.Thr1095Ser |
| | | | Trire2:123786:c.3206T > C | p.Val1069Ala |
| | | | Trire2:123786:c.3172G > A | p.Val1058Ile |
| | | | Trire2:123786:c.3147C > A | p.His1049Gln |
| | | | Trire2:123786:c.2960T > C | p.Ile987Thr |
| | | | Trire2:123786:c.2929A > G | p.Ser977Gly |
| | | | Trire2:123786:c.2902A > T | p.Asn968Tyr |
| | | | Trire2:123786:c.2899A > G | p.Asn967Asp |
| | | | Trire2:123786:c.2892G > T | p.Glu964Asp |
| | | | Trire2:123786:c.2795C > T | p.Ala932Val |
| | | | Trire2:123786:c.2623T > G | p.Cys875Gly |
| | | | Trire2:123786:c.2614A > G | p.Arg872Gly |
| | | | Trire2:123786:c.2593A > G | p.Ile865Val |
| | | | Trire2:123786:c.2564A > T | p.His855Leu |
| | | | Trire2:123786:c.2551G > A | p.Ala851Thr |
| | | | Trire2:123786:c.2530A > G | p.Asn844Asp |
| | | | Trire2:123786:c.2527G > T | p.Asp843Tyr |
| | | | Trire2:123786:c.2503C > A | p.Arg835Ser |
| | | | Trire2:123786:c.2477C > A | p.Thr826Lys |
| | | | Trire2:123786:c.2263A > C | p.Ile755Leu |
| | | | Trire2:123786:c.2206C > G | p.His736Asp |
| | | | Trire2:123786:c.2075C > T | p.Thr692Ile |
| | | | Trire2:123786:c.1986T > G | p.Asp662Glu |
| | | | Trire2:123786:c.1873G > A | p.Ala625Thr |
| | | | Trire2:123786:c.1857C > A | p.Asp619Glu |
| | | | Trire2:123786:c.1808C > T | p.Thr603Ile |
| | | | Trire2:123786:c.1793A > G | p.Asn598Ser |
| | | | Trire2:123786:c.1699T > G | p.Phe567Val |
| | | | Trire2:123786:c.1581A > C | p.Lys527Asn |
| | | | Trire2:123786:c.1525A > C | p.Ile509Leu |
| | | | Trire2:123786:c.1457C > A | p.Pro486Gln |
| | | | Trire2:123786:c.1325A > G | p.His442Arg |
| | | | Trire2:123786:c.1315T > A | p.Ser439Thr |
| | | | Trire2:123786:c.1313G > A | p.Arg438Lys |
| | | | Trire2:123786:c.1279A > G | p.Asn427Asp |
| | | | Trire2:123786:c.1221C > G | p.Ser407Arg |
| | | | Trire2:123786:c.1209A > C | p.Glu403Asp |
| | | | Trire2:123786:c.1172A > G | p.Glu391Gly |
| | | | Trire2:123786:c.1159A > G | p.Lys387Glu |
| | | | Trire2:123786:c.1140C > G | p.Ile380Met |
| | | | Trire2:123786:c.1085A > T | p.Asp362Val |
| | | | Trire2:123786:c.1059C > G | p.Asn353Lys |
| | | | Trire2:123786:c.1057A > G | p.Asn353Asp |
| | | | Trire2:123786:c.1052T > G | p.Val351Gly |
| | | | Trire2:123786:c.1049T > G | p.Val350Gly |
| | | | Trire2:123786:c.1028C > A | p.Thr343Asn |
| | | | Trire2:123786:c.1027A > C | p.Thr343Pro |
| | | | Trire2:123786:c.1019A > C | p.Tyr340Ser |
| | | | Trire2:123786:c.1018T > C | p.Tyr340His |
| | | | Trire2:123786:c.979A > G | p.Ile327Val |
| | | | Trire2:123786:c.973A > C | p.Ser325Arg |
| | | | Trire2:123786:c.875C > T | p.Ser292Leu |
| | | | Trire2:123786:c.764C > G | p.Ala255Gly |
| | | | Trire2:123786:c.746T > A | p.Ile249Asn |
| | | | Trire2:123786:c.743T > C | p.Leu248Pro |
| | | | Trire2:123786:c.673A > G | p.Thr225Ala |
| | | | Trire2:123786:c.656A > G | p.Asp219Gly |
| | | | Trire2:123786:c.618A > C | p.Glu206Asp |
| | | | Trire2:123786:c.547G > T | p.Gly183Cys |
| | | | Trire2:123786:c.500A > G | p.Asn167Ser |
| | | | Trire2:123786:c.499A > G | p.Asn167Asp |
| | | | Trire2:123786:c.446C > G | p.Ser149Cys |
| | | | Trire2:123786:c.365A > G | p.Gln122Arg |
| | | | Trire2:123786:c.362G > A | p.Gly121Asp |
| | | | Trire2:123786:c.353A > C | p.Gln118Pro |
| | | | Trire2:123786:c.346A > G | p.Asn116Asp |
| | | | Trire2:123786:c.313G > A | p.Val105Ile |
| | | | Trire2:123786:c.292G > A | p.Glu98Lys |
| | | | Trire2:123786:c.289A > G | p.Ile97Val |
| | | | Trire2:123786:c.222T > A | p.Asn74Lys |

TABLE 3-continued

List of genes identified by repeated back crossings and sequencing and comparison with corresponding genes in QM6a as outlined above. The coding region change/amino acid change in relation to a corresponding functional gene is indicated
(ins = insertion, del = deletion, fs = frameshift)

| SEQ. ID. No. | Trire2 | Current Data Base Annotation | Coding Region Change | Amino Acid Change |
|---|---|---|---|---|
| | | | Trire2:123786:c.220A > G | p.Asn74Asp |
| | | | Trire2:123786:c.214T > G | p.Cys72Gly |
| | | | Trire2:123786:c.176G > A | p.Gly59Asp |
| | | | Trire2:123786:c.94G > A | p.Asp32Asn |
| | | | Trire2:123786:c.73A > T | p.Lys25* |
| | | | Trire2:123786:c.47T > C | p.Ile16Thr |
| | | | Trire2:123786:c.32C > T | p.Thr11Met |
| | | | Trire2:123786:c.16G > A | p.Ala6Thr |
| 146/147 | 111418 | unknown protein | Trire2:111418:c.711T > G | p.His237Gln |
| | | | Trire2:111418:c.871C > T | p.Pro291Ser |
| 148/149 | 68889 | PDR-type ABC transporters | Trire2:68889:c.204T > A | p.Asn68Lys |
| | | | Trire2:68889:c.377A > G | p.Glu126Gly |
| | | | Trire2:68889:c.853T > C | p.Ser285Pro |
| | | | Trire2:68889:c.953C > G | p.Thr318Ser |
| | | | Trire2:68889:c.1028G > T | p.Arg343Leu |
| | | | Trire2:68889:c.1071G > C | p.Gln357His |
| | | | Trire2:68889:c.1511T > C | p.Ile504Thr |
| | | | Trire2:68889:c.1847A > G | p.Lys616Arg |
| | | | Trire2:68889:c.1957G > T | p.Ala653Ser |
| | | | Trire2:68889:c.3100C > T | p.Pro1034Ser |
| | | | Trire2:68889:c.3535G > A | p.Val1179Ile |
| | | | Trire2:68889:c.3897G > C | p.Glu1299Asp |
| | | | Trire2:68889:c.3974G > A | p.Arg1325Lys |
| 150/151 | 5924 | unknown protein | Trire2:5924:c.143A > G | p.His48Arg |
| | | | Trire2:5924:c.179G > C | p.Ser60Thr |
| | | | Trire2:5924:c.524A > G | p.Glu175Gly |
| 152/153 | 124104 | unknown protein | Trire2:124104:c.4819G > A | p.Ala1607Thr |
| | | | Trire2:124104:c.4260C > A | p.Asn1420Lys |
| | | | Trire2:124104:c.4259A > T | p.Asn1420Ile |
| | | | Trire2:124104:c.4022G > A | p.Arg1341Lys |
| | | | Trire2:124104:c.3749C > T | p.Pro1250Leu |
| | | | Trire2:124104:c.3722T > C | p.Ile1241Thr |
| | | | Trire2:124104:c.3694A > C | p.Ile1232Leu |
| | | | Trire2:124104:c.3668A > G | p.Lys1223Arg |
| | | | Trire2:124104:c.3655G > A | p.Ala1219Thr |
| | | | Trire2:124104:c.3625G > A | p.Val1209Ile |
| | | | Trire2:124104:c.3566A > C | p.His1189Pro |
| | | | Trire2:124104:c.3092T > A | p.Val1031Glu |
| | | | Trire2:124104:c.2884C > T | p.Leu962Phe |
| | | | Trire2:124104:c.2880A > C | p.Glu960Asp |
| | | | Trire2:124104:c.2663G > A | p.Gly888Glu |
| | | | Trire2:124104:c.2600A > C | p.Lys867Thr |
| | | | Trire2:124104:c.2516C > T | p.Thr839Ile |
| | | | Trire2:124104:c.2407T > A | p.Cys803Ser |
| | | | Trire2:124104:c.2074C > T | p.Leu692Phe |
| | | | Trire2:124104:c.1343T > C | p.Val448Ala |
| | | | Trire2:124104:c.1127T > C | p.Val376Ala |
| | | | Trire2:124104:c.866T > C | p.Val289Ala |
| | | | Trire2:124104:c.181T > C | p.Ser61Pro |
| | | | Trire2:124104:c.175G > A | p.Val59Ile |
| 154/155 | 70251 | VHS domain-containing protein | Trire2:70251:c.1756C > T | p.Pro586Ser |
| | | | Trire2:70251:c.1747T > C | p.Ser583Pro |
| | | | Trire2:70251:c.1662A > G | p.Ile554Met |

*This nucleotide exchange occurs in a codon triplet affected by two consecutive mutations. Therefore only the amino acid resulting from combining both exchanges is given in the table.

| SEQ. ID. No. | Trire2 | Current Data Base Annotation | Coding Region Change | Amino Acid Change | Length |
|---|---|---|---|---|---|
| 8/9 | 55213 | smart00552, ADEAMc, tRNA-specific and double-stranded RNA adenosine deaminase | Trire2:55213:c.346delA | p.Lys116fs | 1 |
| | | | Trire2:55213:c.351_352delTG | p.Asp117fs | 2 |
| 44/45 | 59351 | 1-aminocyclopropane-1-carboxylate synthase | Trire2:59351:c.1228delC | p.Leu410fs | 1 |
| 50/51 | 105849 | Zn2Cys6 transcriptional regulator | Trire2:105849:c.50_52delTTG | p.Leu17_Val18delinsLeu | 3 |

| SEQ. ID. No. | Trire2 | Current Data Base Annotation | Coding Region Change | Amino Acid Change | Length |
|---|---|---|---|---|---|
| 68/69 | 59582 | unknown protein | Trire2:59582:c.728delT | p.Val243fs | 1 |
| | | | Trire2:59582:c.730__731insG | p.Ile244fs | 1 |
| 74/75 | 105894 | unknown protein | Trire2:105894:c.233__235delGCA | p.Ser78__Asn79delinsAsn | 3 |
| 92/93 | 59751 | Ribonucleases P/MRP protein subunit POP1 containing protein | Trire2:59751:c.2041__2042insAGC | p.Pro681delinsGlnPro | 3 |
| 110/111 | 76887 | aspartyl protease | Trire2:76887:c.1338delA | p.Ala446fs | 1 |
| 116/117 | 3400 | RRM domain-containing protein | Trire2:3400:c.946__949delGGGA | p.Gly316fs | 4 |
| 128/129 | 110648 | unknown protein | Trire2:110648:c.1758__1759insT | p.Gln587fs | 1 |
| | | | Trire2:110648:c.1753__1754delCA | p.Gln585fs | 2 |
| | | | Trire2:110648:c.1751delC | p.Thr584fs | 1 |
| | | | Trire2:110648:c.1748delC | p.Pro583fs | 1 |
| | | | Trire2:110648:c.792__793insAAC | p.Asn264__Ala265insAsn | 3 |
| 142/143 | 111374 | unique protein | Trire2:111374:c.243__244insC | p.Phe82fs | 1 |
| | | | Trire2:111374:c.247delT | p.Leu83fs | 1 |
| | | | Trire2:111374:c.1124__1125delAG | p.Gln375fs | 2 |
| | | | Trire2:111374:c.1188__1191delTAGG | p.Pro396fs | 4 |
| | | | Trire2:111374:c.1215__1216insT | p.Leu406fs | 1 |
| | | | Trire2:111374:c.1219delA | p.Lys407fs | 1 |
| 144/145 | 123786 | NRPS | Trire2:123786:c.44593__44594insT | p.Thr14865fs | 1 |
| | | | Trire2:123786:c.44591delA | p.His14864fs | 1 |
| | | | Trire2:123786:c.29130delG | p.Glu9710fs | 1 |
| | | | Trire2:123786:c.29126__29127insT | p.Thr9709fs | 1 |
| | | | Trire2:123786:c.28311delA | p.Ala9437fs | 1 |
| | | | Trire2:123786:c.28308__28309insA | p.Ala9437fs | 1 |
| | | | Trire2:123786:c.24460__24461insA | p.Thr8154fs | 1 |
| | | | Trire2:123786:c.24456delA | p.Val8152fs | 1 |
| | | | Trire2:123786:c.1053delT | p.Val351fs | 1 |
| | | | Trire2:123786:c.1049__1050delTT | p.Val350fs | 2 |

TABLE 4

List of Genes indentified as missing in *T. reesei* QM6a

| SEQ ID NO: | Annotation | Highest homology to QM6a sequence |
|---|---|---|
| 163/164 | HET domain containing protein | ID73119 (protein kinase), scaffold 6 |
| 165/166 | hypothetical protein, protein kinase domain | ID73119 (protein kinase), scaffold 6 |
| 167 | putative LAGLIDAGDG endonuclease (mitochondrion) | no homology |
| 168 | putative GIY-YIG endonuclease | no homology |
| 169/170 | hypothetical protein, ankyrin repeat protein | ID111332 (ankyrin repeat protein), scaffold 6 |
| 171/172 | hypothetical protein, nacht and ankyrin domain containing protein | no homology |
| 173 | hypothetical protein | scaffold 6 but not in a gene |
| 174 | hypothetical protein | scaffold 8 but not in a gene |

TABLE 5

List of genes identified by the knock-out strategy as related to mating impairment of *Trichoderma reesei* QM6a

| SEQ. ID. No. | Trire2 | Current Data Base Annotation | Coding Region Change | Amino Acid Change |
|---|---|---|---|---|
| 36/37 | 59391 | GH27 | Trire2:59391:c.1308C > A | p.Ser436Arg |
| | | | Trire2:59391:c.1306A > G | p.Ser436Gly |
| | | | Trire2:59391:c.1195C > G | p.Arg399Gly |
| 40/41 | 105832 | unknown protein | Trire2:105832:c.140A > G | p.Asn47Ser |
| | | | Trire2:105832:c.544A > G | p.Ser182Gly |
| | | | Trire2:105832:c.748G > A | p.Gly250Ser |
| 56/57 | 59188 | unknown protein | Trire2:59188:c.1084A > G | p.Thr362Ala |
| | | | Trire2:59188:c.508A > G | p.Asn170Asp |
| | | | Trire2:59188:c.274T > C | p.Cys92Arg |
| | | | Trire2:59188:c.76A > G | p.Ile26Val |
| 58/59 | 59665 | unknown protein | Trire2:59665:c.350A > G | p.His117Arg |
| | | | Trire2:59665:c.365C > G | p.Ser122* |
| | | | Trire2:59665:c.490T > C | p.Ser164Pro |
| | | | Trire2:59665:c.761G > A | p.Gly254Glu |
| | | | Trire2:59665:c.1120C > T | p.Pro374Ser |
| | | | Trire2:59665:c.1136G > A | p.Arg379Lys |
| | | | Trire2:59665:c.1210T > A | p.Leu404Met |
| | | | Trire2:59665:c.1342A > G | p.Asn448Asp |
| | | | Trire2:59665:c.1395C > G | p.Ile465Met |
| | | | Trire2:59665:c.1415T > A | p.Ile472Asn |
| | | | Trire2:59665:c.1536G > T | p.Gln512His |
| | | | Trire2:59665:c.1585G > A | p.Val529Met |

TABLE 5-continued

List of genes identified by the knock-out strategy as related to mating impairment of *Trichoderma reesei* QM6a

| SEQ. ID. No. | Trire2 | Current Data Base Annotation | Coding Region Change | Amino Acid Change |
|---|---|---|---|---|
| | | | Trire2:59665:c.1709C > T | p.Thr570Met |
| | | | Trire2:59665:c.1970T > C | p.Leu657Ser |
| | | | Trire2:59665:c.1987G > A | p.Ala663Thr |
| | | | Trire2:59665:c.2134G > A | p.Gly712Ser |
| 60/61 | 59669 | extracellular salicylate hydroxylase/monooxygenase, putative | Trire2:59669:c.305A > T | p.Lys102Met |
| | | | Trire2:59669:c.928A > G | p.Ile310Val |
| | | | Trire2:59669:c.943A > G | p.Arg315Gly |
| | | | Trire2:59669:c.1006T > C | p.Cys336Arg |
| | | | Trire2:59669:c.1297T > C | p.Phe433Leu |
| | | | Trire2:59669:c.1299C > G | p.Phe433Leu |
| | | | Trire2:59669:c.1304A > G | p.Lys435Arg |
| | | | Trire2:59669:c.1310T > C | p.Met437Thr |
| | | | Trire2:59669:c.1327T > C | p.Tyr443His |
| | | | Trire2:59669:c.1337C > T | p.Ala446Val |
| 66/67 | 105884 | short chain type dehydrogenase, putative | Trire2:105884:c.58G > A | p.Ala20Thr |
| | | | Trire2:105884:c.73T > C | p.Tyr25His |
| | | | Trire2:105884:c.109A > G | p.Asn37Asp |
| | | | Trire2:105884:c.244G > C | p.Gly82Arg |
| | | | Trire2:105884:c.385G > T | p.Val129Phe |
| | | | Trire2:105884:c.401T > G | p.Val134Gly |
| | | | Trire2:105884:c.488G > A | p.Gly163Glu |
| | | | Trire2:105884:c.541A > C | p.Ser181Arg |
| | | | Trire2:105884:c.662C > T | p.Pro221Leu |
| 68/69 | 59582 | unknown protein | Trire2:59582:c.16A > G | p.Ile6Val |
| | | | Trire2:59582:c.58G > A | p.Val20Ile |
| | | | Trire2:59582:c.61G > A | p.Asp21Asn |
| | | | Trire2:59582:c.455A > G | p.Glu152Gly |
| | | | Trire2:59582:c.637G > A | p.Asp213Asn |
| | | | Trire2:59582:c.643A > G | p.Thr215Ala |
| | | | Trire2:59582:c.724C > T | p.Leu242Phe |
| | | | Trire2:59582:c.741G > C | p.Glu247Asp |
| | | | Trire2:59582:c.797C > G | p.Ala266Gly |
| | | | Trire2:59582:c.806C > T | p.Thr269Ile |
| | | | Trire2:59582:c.874C > T | p.Leu292Phe |
| 72/73 | 76690 | unknown protein | Trire2:76690:c.1729A > G | p.Lys577Glu |
| | | | Trire2:76690:c.1720T > C | p.Cys574Arg |
| | | | Trire2:76690:c.1601C > T | p.Thr534Ile |
| | | | Trire2:76690:c.1076T > A | p.Phe359Tyr |
| | | | Trire2:76690:c.1039G > A | p.Val347Ile |
| | | | Trire2:76690:c.628G > A | p.Ala210Thr |
| 82/83 | 35726 | Subtilisin like protease | Trire2:35726:c.2675A > G | p.Lys892Arg |
| | | | Trire2:35726:c.2572C > G | p.Pro858Ala |
| | | | Trire2:35726:c.2143T > G | p.Ser715Ala |
| | | | Trire2:35726:c.2122A > G | p.Ile708Val |
| | | | Trire2:35726:c.2029A > T | p.Thr677Ser |
| | | | Trire2:35726:c.1874T > A | p.Phe625Tyr |
| | | | Trire2:35726:c.1837T > C | p.Ser613Pro |
| | | | Trire2:35726:c.1814C > A | p.Thr605Lys |
| | | | Trire2:35726:c.1234A > G | p.Asn412Asp |
| | | | Trire2:35726:c.1205G > A | p.Gly402Asp |
| | | | Trire2:35726:c.431A > T | p.Gln144Leu |
| | | | Trire2:35726:c.400C > A | p.Pro134Thr |
| | | | Trire2:35726:c.305T > C | p.Val102Ala |
| | | | Trire2:35726:c.302C > T | p.Ser101Phe |
| | | | Trire2:35726:c.208C > T | p.Leu70Phe |
| 92/93 | 59751 | Ribonucleases P/MRP protein subunit POP1 containing protein | Trire2:59751:c.2442G > T | p.Lys814Asn |
| | | | Trire2:59751:c.2414T > C | p.Leu805Ser |
| | | | Trire2:59751:c.2366T > C | p.Leu789Ser |
| | | | Trire2:59751:c.2352G > C | p.Met784Ile |
| | | | Trire2:59751:c.2312C > A | p.Pro771Gln |
| | | | Trire2:59751:c.2249T > C | p.Leu750Pro |
| | | | Trire2:59751:c.2092A > C | p.Thr698Pro |
| | | | Trire2:59751:c.2071G > A | p.Ala691Thr |
| | | | Trire2:59751:c.2062G > T | p.Ala688Ser |
| | | | Trire2:59751:c.1616C > T | p.Thr539Ile |
| | | | Trire2:59751:c.1495A > G | p.Ser499Gly |
| | | | Trire2:59751:c.1494T > G | p.Asp498Glu |
| | | | Trire2:59751:c.1438A > G | p.Asn480Asp |
| | | | Trire2:59751:c.1289A > G | p.Asp430Gly |
| | | | Trire2:59751:c.1253T > C | p.Val418Ala |
| | | | Trire2:59751:c.977T > A | p.Ile326Asn |
| | | | Trire2:59751:c.578A > G | p.Lys193Arg |

TABLE 5-continued

List of genes identified by the knock-out strategy as related to mating impairment of *Trichoderma reesei* QM6a

| SEQ. ID. No. | Trire2 | Current Data Base Annotation | Coding Region Change | Amino Acid Change |
|---|---|---|---|---|
| 100/101 | 27554 | GH61 | Trire2:27554:c.220T > C | p.Ser74Pro |
| | | | Trire2:27554:c.754C > A | p.Pro252Thr |
| 110/111 | 76887 | aspartyl protease | Trire2:76887:c.146G > A | p.Arg49His |
| | | | Trire2:76887:c.359G > A | p.Arg120Lys |
| | | | Trire2:76887:c.1226T > C | p.Val409Ala |
| | | | Trire2:76887:c.1348A > G | p.Asn450Asp |
| 112/113 | 59270 | unknown protein | Trire2:59270:c.1241G > C | p.Gly414Ala |
| | | | Trire2:59270:c.307G > A | p.Ala103Thr |
| | | | Trire2:59270:c.223T > A | p.Leu75Ile |
| | | | Trire2:59270:c.137T > C | p.Ile46Thr |
| | | | Trire2:59270:c.112G > A | p.Val38Ile |
| 118/119 | 106164 | short chain dehydrogenase/reductase | Trire2:106164:c.61T > C | p.Phe21Leu |
| | | | Trire2:106164:c.70A > G | p.Asn24Asp |
| | | | Trire2:106164:c.71A > G | p.Asn24Ser |
| | | | Trire2:106164:c.181A > G | p.Thr61Ala |
| | | | Trire2:106164:c.595A > G | p.Ile199Val |
| | | | Trire2:106164:c.931G > A | p.Val311Ile |
| | | | Trire2:106164:c.974G > A | p.Gly325Glu |
| 120/121 | 59364 | Sexual differentiation process protein ISP4 | Trire2:59364:c.315T > A | p.His105Gln |
| | | | Trire2:59364:c.316C > G | p.Arg106Gly |
| | | | Trire2:59364:c.564C > A | p.Phe188Leu |
| | | | Trire2:59364:c.565C > A | p.Leu189Met |
| | | | Trire2:59364:c.588C > G | p.Cys196Trp |
| | | | Trire2:59364:c.607G > A | p.Val203Ile |
| | | | Trire2:59364:c.1285G > A | p.Val429Ile |
| | | | Trire2:59364:c.1622C > T | p.Ser541Leu |
| | | | Trire2:59364:c.2531C > T | p.Pro844Leu |
| 122/123 | 3422 | oxidoreductase, putative | Trire2:3422:c.985G > A | p.Ala329Thr |
| | | | Trire2:3422:c.1029G > C | p.Glu343Asp |
| | | | Trire2:3422:c.1204G > A | p.Ala402Thr |
| 124/125 | 47930 | Mitochondrial oxoglutarate/malate carrier proteins | Trire2:47930:c.110A > C | p.Asn37Thr |
| 134/135 | 67350 | unknown unknown protein | Trire2:67350:c.4409C > T | p.Ala1470Val |
| | | | Trire2:67350:c.4187A > T | p.Lys1396Met |
| | | | Trire2:67350:c.3550G > A | p.Ala1184Thr |
| | | | Trire2:67350:c.3437G > A | p.Arg1146Gln |
| | | | Trire2:67350:c.3016A > G | p.Thr1006Ala |
| | | | Trire2:67350:c.2856C > G | p.Asp952Glu |
| | | | Trire2:67350:c.2553T > G | p.Asp851Glu |
| | | | Trire2:67350:c.931C > A | p.His311Asn |
| 138/139 | 81593 | MSF permease | Trire2:81593:c.55G > A | p.Ala19Thr |
| | | | Trire2:81593:c.373A > G | p.Thr125Ala |
| | | | Trire2:81593:c.672A > C | p.Glu224Asp |
| | | | Trire2:81593:c.679G > A | p.Val227Ile |
| | | | Trire2:81593:c.878A > G | p.Lys293Arg |
| | | | Trire2:81593:c.1212G > C | p.Leu404Phe |
| | | | Trire2:81593:c.1237G > T | p.Ala413Ser |
| | | | Trire2:81593:c.1321C > T | p.His441Tyr |
| 144/145 | 123786 | NRPS | Trire2:123786:c.49556A > G | p.Asn16519Ser |
| | | | Trire2:123786:c.49541A > T | p.Glu16514Val |
| | | | Trire2:123786:c.49307C > T | p.Ala16436Val |
| | | | Trire2:123786:c.48743A > G | p.Asn16248Ser |
| | | | Trire2:123786:c.48382G > A | p.Val16128Ile |
| | | | Trire2:123786:c.48125A > T | p.Glu16042Val |
| | | | Trire2:123786:c.47219C > T | p.Ala15740Val |
| | | | Trire2:123786:c.47168G > C | p.Ser15723Thr |
| | | | Trire2:123786:c.47072T > C | p.Val15691Ala |
| | | | Trire2:123786:c.47026A > G | p.Ile15676Val |
| | | | Trire2:123786:c.46894C > T | p.Leu15632Phe |
| | | | Trire2:123786:c.46761C > G | p.Asp15587Glu |
| | | | Trire2:123786:c.46759G > C | p.Asp15587His |
| | | | Trire2:123786:c.46676T > C | p.Val15559Ala |
| | | | Trire2:123786:c.46574A > G | p.Asp15525Gly |
| | | | Trire2:123786:c.46517T > C | p.Ile15506Thr |
| | | | Trire2:123786:c.46498T > G | p.Ser15500Ala |
| | | | Trire2:123786:c.46472T > C | p.Ile15491Thr |
| | | | Trire2:123786:c.46444A > G | p.Lys15482Glu |
| | | | Trire2:123786:c.46442C > T | p.Thr15481Ile |
| | | | Trire2:123786:c.46430C > T | p.Thr15477Ile |
| | | | Trire2:123786:c.46360G > A | p.Val15454Ile |
| | | | Trire2:123786:c.46312C > A | p.Leu15438Ile |
| | | | Trire2:123786:c.46311T > G | p.Asp15437Glu |
| | | | Trire2:123786:c.46287G > T | p.Gln15429His |
| | | | Trire2:123786:c.46255G > A | p.Val15419Met |
| | | | Trire2:123786:c.46241G > A | p.Ser15414Asn |
| | | | Trire2:123786:c.46172A > G | p.Glu15391Gly |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.46006C > A | p.Leu15336Ile |
| | | Trire2:123786:c.46003G > A | p.Ala15335Thr |
| | | Trire2:123786:c.45407C > T | p.Thr15136Ile |
| | | Trire2:123786:c.45385G > A | p.Val15129Ile |
| | | Trire2:123786:c.45302A > G | p.Gln15101Arg |
| | | Trire2:123786:c.45061G > A | p.Ala15021Thr |
| | | Trire2:123786:c.45001T > A | p.Tyr15001Asn |
| | | Trire2:123786:c.45000C > G | p.Asn15000Lys |
| | | Trire2:123786:c.44836G > C | p.Glu14946Gln |
| | | Trire2:123786:c.44827A > C | p.Met14943Leu |
| | | Trire2:123786:c.44824C > G | p.Pro14942Ala |
| | | Trire2:123786:c.44744T > C | p.Val14915Ala |
| | | Trire2:123786:c.44634T > G | p.Asp14878Glu |
| | | Trire2:123786:c.44607G > T | p.Gln14869His |
| | | Trire2:123786:c.44582A > G | p.Gln14861Arg |
| | | Trire2:123786:c.44567G > A | p.Arg14856Gln |
| | | Trire2:123786:c.44315G > A | p.Arg14772Lys |
| | | Trire2:123786:c.43766C > T | p.Pro14589Leu |
| | | Trire2:123786:c.43339G > A | p.Glu14447Lys |
| | | Trire2:123786:c.43315A > G | p.Thr14439Ala |
| | | Trire2:123786:c.43201G > A | p.Glu14401Lys |
| | | Trire2:123786:c.43188G > T | p.Glu14396Asp |
| | | Trire2:123786:c.43111G > T | p.Val14371Leu |
| | | Trire2:123786:c.43090A > G | p.Asn14364Asp |
| | | Trire2:123786:c.43064G > A | p.Arg14355Gln |
| | | Trire2:123786:c.42932C > A | p.Ala14311Glu |
| | | Trire2:123786:c.42762T > G | p.Ile14254Met |
| | | Trire2:123786:c.42756A > C | p.Gln14252His |
| | | Trire2:123786:c.42617G > C | p.Ser14206Thr |
| | | Trire2:123786:c.42568A > G | p.Ile14190Val |
| | | Trire2:123786:c.42481A > T | p.Thr14161Ser |
| | | Trire2:123786:c.42311A > G | p.Lys14104Arg |
| | | Trire2:123786:c.42259A > G | p.Asn14087Asp |
| | | Trire2:123786:c.42176C > T | p.Ser14059Leu |
| | | Trire2:123786:c.42174G > C | p.Glu14058Asp |
| | | Trire2:123786:c.42151C > T | p.Pro14051Ser |
| | | Trire2:123786:c.42134G > A | p.Arg14045His |
| | | Trire2:123786:c.42041G > A | p.Arg14014Lys |
| | | Trire2:123786:c.41911A > G | p.Thr13971Ala |
| | | Trire2:123786:c.41909G > A | p.Arg13970Gln |
| | | Trire2:123786:c.41887T > A | p.Leu13963Met |
| | | Trire2:123786:c.41816C > G | p.Ser13939Cys |
| | | Trire2:123786:c.41807C > A | p.Pro13936Gln |
| | | Trire2:123786:c.41804A > G | p.Glu13935Gly |
| | | Trire2:123786:c.41798G > A | p.Gly13933Asp |
| | | Trire2:123786:c.41789G > T | p.Ser13930Ile |
| | | Trire2:123786:c.41585A > G | p.Gln13862Arg |
| | | Trire2:123786:c.41546T > C | p.Leu13849Ser |
| | | Trire2:123786:c.41498C > A | p.Thr13833Lys |
| | | Trire2:123786:c.41401A > G | p.Ile13801Val |
| | | Trire2:123786:c.41320A > G | p.Thr13774Ala |
| | | Trire2:123786:c.41216T > C | p.Ile13739Thr |
| | | Trire2:123786:c.41198A > G | p.Asn13733Ser |
| | | Trire2:123786:c.41113G > A | p.Asp13705Asn |
| | | Trire2:123786:c.41038G > C | p.Glu13680Gln |
| | | Trire2:123786:c.40626T > A | p.Asp13542Glu |
| | | Trire2:123786:c.40385G > A | p.Gly13462Asp |
| | | Trire2:123786:c.40384G > A | p.Gly13462Ser |
| | | Trire2:123786:c.40375G > A | p.Ala13459Thr |
| | | Trire2:123786:c.40369G > A | p.Glu13457Lys |
| | | Trire2:123786:c.40358A > G | p.Gln13453Arg |
| | | Trire2:123786:c.40309A > G | p.Ile13437Val |
| | | Trire2:123786:c.40294G > A | p.Glu13432Lys |
| | | Trire2:123786:c.40246T > G | p.Phe13416Val |
| | | Trire2:123786:c.40129G > A | p.Val13377Ile |
| | | Trire2:123786:c.40093A > T | p.Thr13365Ser |
| | | Trire2:123786:c.40030G > A | p.Ala13344Thr |
| | | Trire2:123786:c.39926C > T | p.Thr13309Ile |
| | | Trire2:123786:c.39685G > A | p.Gly13229Arg |
| | | Trire2:123786:c.39683A > C | p.Asp13228Ala |
| | | Trire2:123786:c.39634G > A | p.Gly13212Ser |
| | | Trire2:123786:c.39628A > G | p.Asn13210Asp |
| | | Trire2:123786:c.39564C > A | p.Asp13188Glu |
| | | Trire2:123786:c.39501C > G | p.Ser13167Arg |
| | | Trire2:123786:c.39483A > T | p.Glu13161Asp |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.39469A > G | p.Lys13157Glu |
| | | Trire2:123786:c.39460C > T | p.Pro13154Ser |
| | | Trire2:123786:c.39448G > A | p.Asp13150Asn |
| | | Trire2:123786:c.39313C > G | p.Leu13105Val |
| | | Trire2:123786:c.39158G > A | p.Arg13053Lys |
| | | Trire2:123786:c.39134A > G | p.Glu13045Gly |
| | | Trire2:123786:c.39073G > C | p.Glu13025Gln |
| | | Trire2:123786:c.39047A > C | p.Glu13016Ala |
| | | Trire2:123786:c.39034A > G | p.Ile13012Val |
| | | Trire2:123786:c.38977G > C | p.Glu12993Gln |
| | | Trire2:123786:c.38893C > T | p.Arg12965Trp |
| | | Trire2:123786:c.38860A > G | p.Thr12954Ala |
| | | Trire2:123786:c.38753G > A | p.Ser12918Asn |
| | | Trire2:123786:c.38749G > A | p.Val12917Ile |
| | | Trire2:123786:c.38635G > A | p.Val12879Ile |
| | | Trire2:123786:c.38633C > T | p.Ala12878Val |
| | | Trire2:123786:c.38596G > C | p.Ala12866Pro |
| | | Trire2:123786:c.38488A > G | p.Ile12830Val |
| | | Trire2:123786:c.38425G > T | p.Ala12809Ser |
| | | Trire2:123786:c.38230A > G | p.Ser12744Gly |
| | | Trire2:123786:c.38168A > G | p.Lys12723Arg |
| | | Trire2:123786:c.38149G > A | p.Ala12717Thr |
| | | Trire2:123786:c.38143G > A | p.Val12715Ile |
| | | Trire2:123786:c.38059A > G | p.Ile12687Val |
| | | Trire2:123786:c.38039C > T | p.Ser12680Leu |
| | | Trire2:123786:c.38029G > T | p.Val12677Phe |
| | | Trire2:123786:c.38017G > A | p.Gly12673Ser |
| | | Trire2:123786:c.37990T > A | p.Ser12664Thr |
| | | Trire2:123786:c.37982G > A | p.Gly12661Asp |
| | | Trire2:123786:c.37952A > G | p.His12651Arg |
| | | Trire2:123786:c.37945G > A | p.Glu12649Lys |
| | | Trire2:123786:c.37919A > G | p.Glu12640Gly |
| | | Trire2:123786:c.37774A > G | p.Met12592Val |
| | | Trire2:123786:c.37742C > G | p.Ala12581Gly |
| | | Trire2:123786:c.37571G > A | p.Arg12524Lys |
| | | Trire2:123786:c.37555G > T | p.Ala12519Ser |
| | | Trire2:123786:c.37382A > C | p.Asn12461Thr |
| | | Trire2:123786:c.37357G > A | p.Glu12453Lys |
| | | Trire2:123786:c.37297A > C | p.Met12433Leu |
| | | Trire2:123786:c.37015A > C | p.Thr12339Pro |
| | | Trire2:123786:c.36992T > C | p.Val12331Ala |
| | | Trire2:123786:c.36982C > G | p.Gln12328Glu |
| | | Trire2:123786:c.36856T > C | p.Tyr12286His |
| | | Trire2:123786:c.36814G > T | p.Ala12272Ser |
| | | Trire2:123786:c.36811A > G | p.Lys12271Glu |
| | | Trire2:123786:c.36770C > T | p.Ala12257Val |
| | | Trire2:123786:c.36742C > T | p.Leu12248Phe |
| | | Trire2:123786:c.36736A > C | p.Lys12246Gln |
| | | Trire2:123786:c.36711C > A | p.Asp12237Glu |
| | | Trire2:123786:c.36688T > C | p.Cys12230Arg |
| | | Trire2:123786:c.36660T > G | p.Ile12220Met |
| | | Trire2:123786:c.36646C > T | p.Pro12216Ser |
| | | Trire2:123786:c.36638G > A | p.Arg12213Lys |
| | | Trire2:123786:c.36630G > C | p.Lys12210Asn |
| | | Trire2:123786:c.36626A > G | p.Glu12209Gly |
| | | Trire2:123786:c.36625G > A | p.Glu12209Lys |
| | | Trire2:123786:c.36616A > G | p.Lys12206Glu |
| | | Trire2:123786:c.36496G > A | p.Val12166Ile |
| | | Trire2:123786:c.36478T > C | p.Phe12160Leu |
| | | Trire2:123786:c.36409T > A | p.Leu12137Met |
| | | Trire2:123786:c.36392C > T | p.Ser12131Leu |
| | | Trire2:123786:c.36374A > T | p.Gln12125Leu |
| | | Trire2:123786:c.36373C > T | p.Gln12125* |
| | | Trire2:123786:c.36361C > A | p.His12121Asn |
| | | Trire2:123786:c.36355G > A | p.Gly12119Ser |
| | | Trire2:123786:c.36328G > A | p.Val12110Ile |
| | | Trire2:123786:c.36191G > A | p.Arg12064Gln |
| | | Trire2:123786:c.35994T > G | p.Asn11998Lys |
| | | Trire2:123786:c.35885A > G | p.Asn11962Ser |
| | | Trire2:123786:c.35878A > G | p.Thr11960Ala |
| | | Trire2:123786:c.35816C > A | p.Pro11939Gln |
| | | Trire2:123786:c.35799G > A | p.Met11933Ile |
| | | Trire2:123786:c.35706G > A | p.Met11902Ile |
| | | Trire2:123786:c.35705T > A | p.Met11902Lys |
| | | Trire2:123786:c.35698A > G | p.Ile11900Val |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
| --- | --- | --- | --- |
| | | Trire2:123786:c.35687G > A | p.Ser11896Asn |
| | | Trire2:123786:c.35653G > T | p.Gly11885Cys |
| | | Trire2:123786:c.35613A > C | p.Glu11871Asp |
| | | Trire2:123786:c.35603C > A | p.Ala11868Glu |
| | | Trire2:123786:c.35567G > A | p.Ser11856Asn |
| | | Trire2:123786:c.35563G > A | p.Gly11855Arg |
| | | Trire2:123786:c.35559G > T | p.Met11853Ile |
| | | Trire2:123786:c.35520G > C | p.Met11840Ile |
| | | Trire2:123786:c.35519T > C | p.Met11840Thr |
| | | Trire2:123786:c.35503T > A | p.Ser11835Thr |
| | | Trire2:123786:c.35492T > C | p.Leu11831Ser |
| | | Trire2:123786:c.35480C > G | p.Thr11827Ser |
| | | Trire2:123786:c.35432A > G | p.Lys11811Arg |
| | | Trire2:123786:c.35349T > A | p.Asn11783Lys |
| | | Trire2:123786:c.35348A > G | p.Asn11783Ser |
| | | Trire2:123786:c.35337T > A | p.Asp11779Glu |
| | | Trire2:123786:c.35321T > C | p.Leu11774Ser |
| | | Trire2:123786:c.35270A > C | p.Gln11757Pro |
| | | Trire2:123786:c.35261G > A | p.Arg11754Lys |
| | | Trire2:123786:c.35260A > G | p.Arg11754Gly |
| | | Trire2:123786:c.35184C > G | p.Asn11728Lys |
| | | Trire2:123786:c.35148C > G | p.Ile11716Met |
| | | Trire2:123786:c.35051A > G | p.Lys11684Arg |
| | | Trire2:123786:c.34845A > T | p.Arg11615Ser |
| | | Trire2:123786:c.34826G > C | p.Arg11609Pro |
| | | Trire2:123786:c.34793C > T | p.Ser11598Leu |
| | | Trire2:123786:c.34760G > A | p.Gly11587Glu |
| | | Trire2:123786:c.34732C > T | p.Leu11578Phe |
| | | Trire2:123786:c.34724G > C | p.Gly11575Ala |
| | | Trire2:123786:c.34573T > C | p.Ser11525Pro |
| | | Trire2:123786:c.34492C > T | p.Pro11498Ser |
| | | Trire2:123786:c.34464G > T | p.Glu11488Asp |
| | | Trire2:123786:c.34424C > T | p.Ala11475Val |
| | | Trire2:123786:c.34316C > A | p.Ala11439Asp |
| | | Trire2:123786:c.34297G > T | p.Val11433Leu |
| | | Trire2:123786:c.34189C > A | p.Leu11397Ile |
| | | Trire2:123786:c.34109A > G | p.Lys11370Arg |
| | | Trire2:123786:c.33967T > C | p.Ser11323Pro |
| | | Trire2:123786:c.33949A > G | p.Thr11317Ala |
| | | Trire2:123786:c.33922C > T | p.Leu11308Phe |
| | | Trire2:123786:c.33904G > A | p.Val11302Ile |
| | | Trire2:123786:c.33862A > G | p.Ile11288Val |
| | | Trire2:123786:c.33853C > G | p.Pro11285Ala |
| | | Trire2:123786:c.33830C > G | p.Pro11277Arg |
| | | Trire2:123786:c.33814T > C | p.Ser11272Pro |
| | | Trire2:123786:c.33806G > A | p.Arg11269His |
| | | Trire2:123786:c.33761C > A | p.Thr11254Lys |
| | | Trire2:123786:c.33749C > G | p.Ala11250Gly |
| | | Trire2:123786:c.33739G > A | p.Glu11247Lys |
| | | Trire2:123786:c.33695T > A | p.Leu11232His |
| | | Trire2:123786:c.33687G > C | p.Gln11229His |
| | | Trire2:123786:c.33674C > A | p.Ala11225Glu |
| | | Trire2:123786:c.33568T > C | p.Phe11190Leu |
| | | Trire2:123786:c.33563G > A | p.Gly11188Asp |
| | | Trire2:123786:c.33562G > A | p.Gly11188Ser |
| | | Trire2:123786:c.33545G > C | p.Ser11182Thr |
| | | Trire2:123786:c.33403A > G | p.Ile11135Val |
| | | Trire2:123786:c.33373T > A | p.Leu11125Ile |
| | | Trire2:123786:c.33366A > T | p.Glu11122Asp |
| | | Trire2:123786:c.33341T > C | p.Leu11114Ser |
| | | Trire2:123786:c.33331G > A | p.Glu11111Lys |
| | | Trire2:123786:c.33320G > C | p.Gly11107Ala |
| | | Trire2:123786:c.33311C > T | p.Ser11104Leu |
| | | Trire2:123786:c.33277G > A | p.Glu11093Lys |
| | | Trire2:123786:c.33235G > A | p.Asp11079Asn |
| | | Trire2:123786:c.33211A > G | p.Lys11071Glu |
| | | Trire2:123786:c.33206G > A | p.Gly11069Asp |
| | | Trire2:123786:c.33141A > C | p.Glu11047Asp |
| | | Trire2:123786:c.33122C > T | p.Ser11041Phe |
| | | Trire2:123786:c.33121T > G | p.Ser11041Ala |
| | | Trire2:123786:c.32968G > A | p.Gly10990Ser |
| | | Trire2:123786:c.32936C > T | p.Pro10979Leu |
| | | Trire2:123786:c.32891T > C | p.Val10964Ala |
| | | Trire2:123786:c.32833A > G | p.Ile10945Val |
| | | Trire2:123786:c.32696T > C | p.Val10899Ala |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.32693T > C | p.Val10898Ala |
| | | Trire2:123786:c.32672T > C | p.Leu10891Pro |
| | | Trire2:123786:c.32664G > C | p.Leu10888Phe |
| | | Trire2:123786:c.32608G > A | p.Glu10870Lys |
| | | Trire2:123786:c.32601A > G | p.Ile10867Met |
| | | Trire2:123786:c.32584C > A | p.Gln10862Lys |
| | | Trire2:123786:c.32546T > A | p.Leu10849His |
| | | Trire2:123786:c.32450G > A | p.Arg10817Gln |
| | | Trire2:123786:c.32437G > C | p.Glu10813Gln |
| | | Trire2:123786:c.32397A > C | p.Lys10799Asn |
| | | Trire2:123786:c.32323A > G | p.Asn10775Asp |
| | | Trire2:123786:c.32218G > A | p.Val10740Met |
| | | Trire2:123786:c.32094C > A | p.Asp10698Glu |
| | | Trire2:123786:c.32013G > T | p.Glu10671Asp |
| | | Trire2:123786:c.31997T > C | p.Leu10666Ser |
| | | Trire2:123786:c.31924G > A | p.Asp10642Asn |
| | | Trire2:123786:c.31833T > G | p.Asp10611Glu |
| | | Trire2:123786:c.31813A > G | p.Ile10605Val |
| | | Trire2:123786:c.31741G > A | p.Ala10581Thr |
| | | Trire2:123786:c.31573G > A | p.Val10525Ile |
| | | Trire2:123786:c.31484C > T | p.Thr10495Ile |
| | | Trire2:123786:c.31412G > A | p.Arg10471Gln |
| | | Trire2:123786:c.31408A > G | p.Thr10470Ala |
| | | Trire2:123786:c.31282C > A | p.Pro10428Thr |
| | | Trire2:123786:c.31280G > A | p.Arg10427Gln |
| | | Trire2:123786:c.31093C > A | p.Leu10365Ile |
| | | Trire2:123786:c.31084C > T | p.Pro10362Ser |
| | | Trire2:123786:c.30853G > T | p.Ala10285Ser |
| | | Trire2:123786:c.30552T > G | p.Asp10184Glu |
| | | Trire2:123786:c.30536C > T | p.Ala10179Val |
| | | Trire2:123786:c.30509G > A | p.Gly10170Glu |
| | | Trire2:123786:c.30340G > A | p.Val10114Ile |
| | | Trire2:123786:c.30321T > G | p.Asp10107Glu |
| | | Trire2:123786:c.30319G > C | p.Asp10107His |
| | | Trire2:123786:c.30290C > T | p.Ala10097Val |
| | | Trire2:123786:c.30289G > A | p.Ala10097Thr |
| | | Trire2:123786:c.30282A > C | p.Lys10094Asn |
| | | Trire2:123786:c.30135A > T | p.Glu10045Asp |
| | | Trire2:123786:c.30100A > C | p.Met10034Leu |
| | | Trire2:123786:c.30036C > G | p.Asp10012Glu |
| | | Trire2:123786:c.29989G > T | p.Ala9997Ser |
| | | Trire2:123786:c.29985G > C | p.Glu9995Asp |
| | | Trire2:123786:c.29870G > T | p.Gly9957Val |
| | | Trire2:123786:c.29863C > A | p.Pro9955Thr |
| | | Trire2:123786:c.29782A > C | p.Asn9928His |
| | | Trire2:123786:c.29692C > T | p.Leu9898Phe |
| | | Trire2:123786:c.29654T > C | p.Val9885Ala |
| | | Trire2:123786:c.29636A > C | p.Gln9879Pro |
| | | Trire2:123786:c.29560G > A | p.Val9854Ile |
| | | Trire2:123786:c.29405C > T | p.Thr9802Ile |
| | | Trire2:123786:c.29399T > A | p.Phe9800Tyr |
| | | Trire2:123786:c.29332C > T | p.Pro9778Ser |
| | | Trire2:123786:c.29225A > G | p.Asp9742Gly |
| | | Trire2:123786:c.29191G > C | p.Ala9731Pro |
| | | Trire2:123786:c.29120G > A | p.Arg9707Gln |
| | | Trire2:123786:c.29111A > G | p.Asn9704Ser |
| | | Trire2:123786:c.29080G > A | p.Glu9694Lys |
| | | Trire2:123786:c.29023A > G | p.Asn9675Asp |
| | | Trire2:123786:c.28988G > A | p.Arg9663Lys |
| | | Trire2:123786:c.28856A > G | p.Lys9619Arg |
| | | Trire2:123786:c.28813A > C | p.Thr9605Pro |
| | | Trire2:123786:c.28791T > A | p.His9597Gln |
| | | Trire2:123786:c.28657A > C | p.Ile9553Leu |
| | | Trire2:123786:c.28574A > G | p.Gln9525Arg |
| | | Trire2:123786:c.28555G > A | p.Glu9519Lys |
| | | Trire2:123786:c.28531A > G | p.Ser9511Gly |
| | | Trire2:123786:c.28498G > A | p.Asp9500Asn |
| | | Trire2:123786:c.28483A > C | p.Met9495Leu |
| | | Trire2:123786:c.28393A > T | p.Thr9465Ser |
| | | Trire2:123786:c.28340A > G | p.Asp9447Gly |
| | | Trire2:123786:c.28328C > T | p.Ala9443Val |
| | | Trire2:123786:c.28316G > A | p.Gly9439Asp |
| | | Trire2:123786:c.28301T > A | p.Leu9434Gln |
| | | Trire2:123786:c.28268G > A | p.Ser9423Asn |
| | | Trire2:123786:c.28194C > G | p.Asp9398Glu |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.28188T > G | p.Ile9396Met |
| | | Trire2:123786:c.28084G > A | p.Gly9362Ser |
| | | Trire2:123786:c.28052A > G | p.Lys9351Arg |
| | | Trire2:123786:c.28028G > A | p.Arg9343Gln |
| | | Trire2:123786:c.27827T > C | p.Val9276Ala |
| | | Trire2:123786:c.27626A > G | p.Lys9209Arg |
| | | Trire2:123786:c.27623C > T | p.Thr9208Met |
| | | Trire2:123786:c.27358A > C | p.Asn9120His |
| | | Trire2:123786:c.27314T > G | p.Val9105Gly |
| | | Trire2:123786:c.27265C > G | p.Leu9089Val |
| | | Trire2:123786:c.27229T > A | p.Ser9077Thr |
| | | Trire2:123786:c.27115G > A | p.Val9039Ile |
| | | Trire2:123786:c.27096A > T | p.Glu9032Asp |
| | | Trire2:123786:c.26957C > T | p.Ala8986Val |
| | | Trire2:123786:c.26929A > C | p.Lys8977Gln |
| | | Trire2:123786:c.26881G > A | p.Val8961Ile |
| | | Trire2:123786:c.26773A > G | p.Ile8925Val |
| | | Trire2:123786:c.26618G > A | p.Gly8873Asp |
| | | Trire2:123786:c.26536G > A | p.Asp8846Asn |
| | | Trire2:123786:c.26483T > C | p.Met8828Thr |
| | | Trire2:123786:c.26466C > G | p.Asp8822Glu |
| | | Trire2:123786:c.26443C > T | p.Pro8815Ser |
| | | Trire2:123786:c.26438G > T | p.Gly8813Val |
| | | Trire2:123786:c.26413G > A | p.Val8805Ile |
| | | Trire2:123786:c.26311T > A | p.Cys8771Ser |
| | | Trire2:123786:c.26108C > A | p.Ala8703Glu |
| | | Trire2:123786:c.26099C > T | p.Ser8700Leu |
| | | Trire2:123786:c.26028T > G | p.Asp8676Glu |
| | | Trire2:123786:c.25958G > A | p.Arg8653His |
| | | Trire2:123786:c.25847C > T | p.Ser8616Phe |
| | | Trire2:123786:c.25845G > T | p.Glu8615Asp |
| | | Trire2:123786:c.25761G > C | p.Glu8587Asp |
| | | Trire2:123786:c.25582T > C | p.Cys8528Arg |
| | | Trire2:123786:c.25549T > A | p.Leu8517Met |
| | | Trire2:123786:c.25532T > C | p.Met8511Thr |
| | | Trire2:123786:c.25270A > T | p.Thr8424Ser |
| | | Trire2:123786:c.25253C > G | p.Thr8418Ser |
| | | Trire2:123786:c.25100G > A | p.Gly8367Asp |
| | | Trire2:123786:c.25091T > A | p.Leu8364His |
| | | Trire2:123786:c.25083G > C | p.Leu8361Phe |
| | | Trire2:123786:c.25071A > T | p.Gln8357His |
| | | Trire2:123786:c.25064C > T | p.Ala8355Val |
| | | Trire2:123786:c.25057A > G | p.Asn8353Asp |
| | | Trire2:123786:c.25013G > C | p.Gly8338Ala |
| | | Trire2:123786:c.24919C > T | p.Arg8307Cys |
| | | Trire2:123786:c.24868A > G | p.Ile8290Val |
| | | Trire2:123786:c.24817A > G | p.Ile8273Val |
| | | Trire2:123786:c.24805C > T | p.Pro8269Ser |
| | | Trire2:123786:c.24740T > C | p.Val8247Ala |
| | | Trire2:123786:c.24733T > C | p.Tyr8245His |
| | | Trire2:123786:c.24708C > A | p.Asp8236Glu |
| | | Trire2:123786:c.24698C > T | p.Ala8233Val |
| | | Trire2:123786:c.24640G > A | p.Val8214Ile |
| | | Trire2:123786:c.24560G > T | p.Arg8187Met |
| | | Trire2:123786:c.24485A > T | p.Tyr8162Phe |
| | | Trire2:123786:c.24454G > A | p.Val8152Ile |
| | | Trire2:123786:c.24415G > A | p.Val8139Ile |
| | | Trire2:123786:c.24406T > G | p.Cys8136Gly |
| | | Trire2:123786:c.24399C > G | p.Asp8133Glu |
| | | Trire2:123786:c.24242G > C | p.Cys8081Ser |
| | | Trire2:123786:c.24202T > A | p.Ser8068Thr |
| | | Trire2:123786:c.24196G > A | p.Asp8066Asn |
| | | Trire2:123786:c.24190C > T | p.Leu8064Phe |
| | | Trire2:123786:c.24182A > G | p.Asn8061Ser |
| | | Trire2:123786:c.24146G > T | p.Gly8049Val |
| | | Trire2:123786:c.24044T > C | p.Leu8015Pro |
| | | Trire2:123786:c.24037G > A | p.Asp8013Asn |
| | | Trire2:123786:c.24031A > G | p.Thr8011Ala |
| | | Trire2:123786:c.23797G > A | p.Val7933Ile |
| | | Trire2:123786:c.23635C > T | p.Arg7879* |
| | | Trire2:123786:c.23600C > T | p.Ala7867Val |
| | | Trire2:123786:c.23592C > A | p.Asp7864Glu |
| | | Trire2:123786:c.23591A > G | p.Asp7864Gly |
| | | Trire2:123786:c.23545A > G | p.Asn7849Asp |
| | | Trire2:123786:c.23525A > C | p.Glu7842Ala |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.23183G > A | p.Arg7728Gln |
| | | Trire2:123786:c.23164T > C | p.Ser7722Pro |
| | | Trire2:123786:c.23092C > T | p.Pro7698Ser |
| | | Trire2:123786:c.22976G > A | p.Ser7659Asn |
| | | Trire2:123786:c.22948A > T | p.Thr7650Ser |
| | | Trire2:123786:c.22919A > G | p.Glu7640Gly |
| | | Trire2:123786:c.22822G > A | p.Gly7608Ser |
| | | Trire2:123786:c.22772T > C | p.Leu7591Ser |
| | | Trire2:123786:c.22771T > G | p.Leu7591Val |
| | | Trire2:123786:c.22766C > A | p.Thr7589Asn |
| | | Trire2:123786:c.22594A > T | p.Met7532Leu |
| | | Trire2:123786:c.22591A > G | p.Thr7531Ala |
| | | Trire2:123786:c.22560A > C | p.Arg7520Ser |
| | | Trire2:123786:c.22552G > A | p.Val7518Ile |
| | | Trire2:123786:c.22531A > G | p.Asn7511Asp |
| | | Trire2:123786:c.22297G > A | p.Gly7433Arg |
| | | Trire2:123786:c.22285A > G | p.Lys7429Glu |
| | | Trire2:123786:c.22267G > A | p.Val7423Ile |
| | | Trire2:123786:c.22224C > A | p.Asp7408Glu |
| | | Trire2:123786:c.22153C > T | p.Pro7385Ser |
| | | Trire2:123786:c.22133T > A | p.Ile7378Lys |
| | | Trire2:123786:c.22016T > C | p.Leu7339Ser |
| | | Trire2:123786:c.21961A > G | p.Thr7321Ala |
| | | Trire2:123786:c.21845T > A | p.Leu7282His |
| | | Trire2:123786:c.21776C > A | p.Ala7259Glu |
| | | Trire2:123786:c.21500T > A | p.Val7167Asp |
| | | Trire2:123786:c.21306A > C | p.Lys7102Asn |
| | | Trire2:123786:c.20936A > C | p.Lys6979Thr |
| | | Trire2:123786:c.20807C > T | p.Pro6936Leu |
| | | Trire2:123786:c.20803A > G | p.Ile6935Val |
| | | Trire2:123786:c.20756G > C | p.Ser6919Thr |
| | | Trire2:123786:c.20752G > C | p.Ala6918Pro |
| | | Trire2:123786:c.20434G > A | p.Val6812Ile |
| | | Trire2:123786:c.20098G > A | p.Val6700Ile |
| | | Trire2:123786:c.20051C > T | p.Thr6684Met |
| | | Trire2:123786:c.19957T > C | p.Ser6653Pro |
| | | Trire2:123786:c.19916G > A | p.Cys6639Tyr |
| | | Trire2:123786:c.19772G > A | p.Arg6591Gln |
| | | Trire2:123786:c.19697A > G | p.Asp6566Gly |
| | | Trire2:123786:c.19670C > T | p.Thr6557Ile |
| | | Trire2:123786:c.19627T > A | p.Ser6543Thr |
| | | Trire2:123786:c.19625A > G | p.His6542Arg |
| | | Trire2:123786:c.19602C > A | p.Asn6534Lys |
| | | Trire2:123786:c.19529C > A | p.Pro6510His |
| | | Trire2:123786:c.19525T > C | p.Ser6509Pro |
| | | Trire2:123786:c.19504G > A | p.Val6502Ile |
| | | Trire2:123786:c.19414A > G | p.Asn6472Asp |
| | | Trire2:123786:c.19408A > G | p.Lys6470Glu |
| | | Trire2:123786:c.19217C > A | p.Thr6406Lys |
| | | Trire2:123786:c.19186C > T | p.Pro6396Ser |
| | | Trire2:123786:c.19088C > T | p.Ala6363Val |
| | | Trire2:123786:c.19040A > G | p.Lys6347Arg |
| | | Trire2:123786:c.19033A > G | p.Ile6345Val |
| | | Trire2:123786:c.19023G > T | p.Leu6341Phe |
| | | Trire2:123786:c.18997G > C | p.Val6333Leu |
| | | Trire2:123786:c.18968A > G | p.His6323Arg |
| | | Trire2:123786:c.18911G > A | p.Gly6304Asp |
| | | Trire2:123786:c.18850A > C | p.Met6284Leu |
| | | Trire2:123786:c.18654A > T | p.Gln6218His |
| | | Trire2:123786:c.18389A > G | p.Gln6130Arg |
| | | Trire2:123786:c.18238G > A | p.Gly6080Ser |
| | | Trire2:123786:c.18166T > C | p.Ser6056Pro |
| | | Trire2:123786:c.18052G > C | p.Gly6018Arg |
| | | Trire2:123786:c.17972A > C | p.Lys5991Thr |
| | | Trire2:123786:c.17920G > A | p.Val5974Ile |
| | | Trire2:123786:c.17693T > A | p.Leu5898Gln |
| | | Trire2:123786:c.17554A > G | p.Thr5852Ala |
| | | Trire2:123786:c.17503C > T | p.Pro5835Ser |
| | | Trire2:123786:c.17498A > G | p.Asp5833Gly |
| | | Trire2:123786:c.17368C > G | p.Leu5790Val |
| | | Trire2:123786:c.17317A > T | p.Ile5773Leu |
| | | Trire2:123786:c.17253C > G | p.Ser5751Arg |
| | | Trire2:123786:c.17234C > A | p.Thr5745Asn |
| | | Trire2:123786:c.17143C > T | p.Pro5715Ser |
| | | Trire2:123786:c.17141T > C | p.Leu5714Pro |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.17120G > C | p.Arg5707Thr |
| | | Trire2:123786:c.17095A > G | p.Ser5699Gly |
| | | Trire2:123786:c.17047G > A | p.Val5683Ile |
| | | Trire2:123786:c.17002G > A | p.Ala5668Thr |
| | | Trire2:123786:c.16993G > C | p.Gly5665Arg |
| | | Trire2:123786:c.16964A > G | p.Asn5655Ser |
| | | Trire2:123786:c.16857G > T | p.Glu5619Asp |
| | | Trire2:123786:c.16837T > C | p.Ser5613Pro |
| | | Trire2:123786:c.16816C > T | p.Leu5606Phe |
| | | Trire2:123786:c.16802G > A | p.Ser5601Asn |
| | | Trire2:123786:c.16751A > T | p.Tyr5584Phe |
| | | Trire2:123786:c.16741T > C | p.Tyr5581His |
| | | Trire2:123786:c.16708G > A | p.Gly5570Ser |
| | | Trire2:123786:c.16698A > C | p.Glu5566Asp |
| | | Trire2:123786:c.16688A > G | p.Lys5563Arg |
| | | Trire2:123786:c.16666G > A | p.Val5556Ile |
| | | Trire2:123786:c.16487T > G | p.Val5496Gly |
| | | Trire2:123786:c.16486G > C | p.Val5496Leu |
| | | Trire2:123786:c.16447C > G | p.Gln5483Glu |
| | | Trire2:123786:c.16444G > A | p.Gly5482Ser |
| | | Trire2:123786:c.16210G > A | p.Val5404Ile |
| | | Trire2:123786:c.16146A > C | p.Gln5382His |
| | | Trire2:123786:c.16033A > G | p.Ile5345Val |
| | | Trire2:123786:c.15964G > A | p.Val5322Ile |
| | | Trire2:123786:c.15959G > C | p.Ser5320Thr |
| | | Trire2:123786:c.15821A > G | p.Gln5274Arg |
| | | Trire2:123786:c.15818T > A | p.Met5273Lys |
| | | Trire2:123786:c.15794C > A | p.Pro5265Gln |
| | | Trire2:123786:c.15763A > C | p.Asn5255His |
| | | Trire2:123786:c.15760G > A | p.Asp5254Asn |
| | | Trire2:123786:c.15642C > A | p.His5214Gln |
| | | Trire2:123786:c.15622G > C | p.Asp5208His |
| | | Trire2:123786:c.15582T > A | p.Asp5194Glu |
| | | Trire2:123786:c.15313G > A | p.Val5105Ile |
| | | Trire2:123786:c.15308T > C | p.Val5103Ala |
| | | Trire2:123786:c.15203C > A | p.Ser5068Tyr |
| | | Trire2:123786:c.15179A > T | p.Gln5060Leu |
| | | Trire2:123786:c.15061C > T | p.Pro5021Ser |
| | | Trire2:123786:c.14984G > C | p.Cys4995Ser |
| | | Trire2:123786:c.14606G > A | p.Ser4869Asn |
| | | Trire2:123786:c.14449G > C | p.Gly4817Arg |
| | | Trire2:123786:c.14309A > T | p.Gln4770Leu |
| | | Trire2:123786:c.14242C > T | p.Pro4748Ser |
| | | Trire2:123786:c.14204T > C | p.Ile4735Thr |
| | | Trire2:123786:c.14042C > T | p.Pro4681Leu |
| | | Trire2:123786:c.14035A > G | p.Ile4679Val |
| | | Trire2:123786:c.14022A > G | p.Ile4674Met |
| | | Trire2:123786:c.13987G > A | p.Asp4663Asn |
| | | Trire2:123786:c.13823C > T | p.Ala4608Val |
| | | Trire2:123786:c.13585C > A | p.Gln4529Lys |
| | | Trire2:123786:c.13457C > T | p.Ala4486Val |
| | | Trire2:123786:c.13423G > A | p.Ala4475Thr |
| | | Trire2:123786:c.13169A > C | p.Tyr4390Ser |
| | | Trire2:123786:c.13146T > G | p.Asn4382Lys |
| | | Trire2:123786:c.13145A > T | p.Asn4382Ile |
| | | Trire2:123786:c.12686A > C | p.Glu4229Ala |
| | | Trire2:123786:c.12307C > T | p.His4103Tyr |
| | | Trire2:123786:c.12252T > G | p.Ser4084Arg |
| | | Trire2:123786:c.11990A > C | p.Glu3997Ala |
| | | Trire2:123786:c.11656A > G | p.Asn3886Asp |
| | | Trire2:123786:c.11152G > A | p.Glu3718Lys |
| | | Trire2:123786:c.11024G > A | p.Ser3675Asn |
| | | Trire2:123786:c.11000C > T | p.Pro3667Leu |
| | | Trire2:123786:c.10979G > C | p.Gly3660Ala |
| | | Trire2:123786:c.10947G > T | p.Met3649Ile |
| | | Trire2:123786:c.10927G > A | p.Ala3643Thr |
| | | Trire2:123786:c.10925T > C | p.Leu3642Pro |
| | | Trire2:123786:c.10783G > A | p.Asp3595Asn |
| | | Trire2:123786:c.10765C > G | p.Leu3589Val |
| | | Trire2:123786:c.10705G > A | p.Glu3569Lys |
| | | Trire2:123786:c.10704T > G | p.Asp3568Glu |
| | | Trire2:123786:c.10683T > G | p.Asp3561Glu |
| | | Trire2:123786:c.10639A > G | p.Lys3547Glu |
| | | Trire2:123786:c.10556G > A | p.Gly3519Asp |
| | | Trire2:123786:c.10511G > A | p.Arg3504Gln |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.10324T > G | p.Ser3442Ala |
| | | Trire2:123786:c.10295A > T | p.Lys3432Met |
| | | Trire2:123786:c.10284T > A | p.His3428Gln |
| | | Trire2:123786:c.10139A > G | p.Lys3380Arg |
| | | Trire2:123786:c.10135A > T | p.Met3379Leu |
| | | Trire2:123786:c.10045A > G | p.Met3349Val |
| | | Trire2:123786:c.10031A > T | p.Lys3344Met |
| | | Trire2:123786:c.10019C > A | p.Pro3340Gln |
| | | Trire2:123786:c.9971C > T | p.Pro3324Leu |
| | | Trire2:123786:c.9608C > T | p.Ala3203Val |
| | | Trire2:123786:c.9478G > A | p.Ala3160Thr |
| | | Trire2:123786:c.9409A > G | p.Arg3137Gly |
| | | Trire2:123786:c.9263A > G | p.Lys3088Arg |
| | | Trire2:123786:c.9252A > C | p.Glu3084Asp |
| | | Trire2:123786:c.9247A > G | p.Thr3083Ala |
| | | Trire2:123786:c.9230A > G | p.Gln3077Arg |
| | | Trire2:123786:c.9154A > G | p.Ser3052Gly |
| | | Trire2:123786:c.9001G > A | p.Ala3001Thr |
| | | Trire2:123786:c.8963A > G | p.Glu2988Gly |
| | | Trire2:123786:c.8945C > G | p.Ala2982Gly |
| | | Trire2:123786:c.8941G > A | p.Asp2981Asn |
| | | Trire2:123786:c.8918A > C | p.Tyr2973Ser |
| | | Trire2:123786:c.8697A > G | p.Ile2899Met |
| | | Trire2:123786:c.8671A > C | p.Thr2891Pro |
| | | Trire2:123786:c.8654C > T | p.Ser2885Phe |
| | | Trire2:123786:c.8569G > A | p.Val2857Ile |
| | | Trire2:123786:c.8545G > A | p.Asp2849Asn |
| | | Trire2:123786:c.8509A > G | p.Thr2837Ala |
| | | Trire2:123786:c.8488A > C | p.Met2830Leu |
| | | Trire2:123786:c.8354T > C | p.Ile2785Thr |
| | | Trire2:123786:c.8347G > A | p.Val2783Ile |
| | | Trire2:123786:c.8104T > C | p.Ser2702Pro |
| | | Trire2:123786:c.8062C > A | p.Leu2688Ile |
| | | Trire2:123786:c.7963G > A | p.Val2655Met |
| | | Trire2:123786:c.7961C > T | p.Pro2654Leu |
| | | Trire2:123786:c.7943C > A | p.Ala2648Glu |
| | | Trire2:123786:c.7852A > G | p.Asn2618Asp |
| | | Trire2:123786:c.7651G > T | p.Ala2551Ser |
| | | Trire2:123786:c.7558A > G | p.Lys2520Glu |
| | | Trire2:123786:c.7517A > G | p.Gln2506Arg |
| | | Trire2:123786:c.7501A > G | p.Ser2501Gly |
| | | Trire2:123786:c.7252A > G | p.Asn2418Asp |
| | | Trire2:123786:c.7240G > C | p.Gly2414Arg |
| | | Trire2:123786:c.7238C > G | p.Thr2413Ser |
| | | Trire2:123786:c.7156A > G | p.Asn2386Asp |
| | | Trire2:123786:c.6956G > A | p.Ser2319Asn |
| | | Trire2:123786:c.6895A > G | p.Thr2299Ala |
| | | Trire2:123786:c.6883A > T | p.Thr2295Ser |
| | | Trire2:123786:c.6749C > G | p.Thr2250Ser |
| | | Trire2:123786:c.6681C > G | p.Asp2227Glu |
| | | Trire2:123786:c.6677G > A | p.Arg2226Lys |
| | | Trire2:123786:c.6620T > C | p.Leu2207Ser |
| | | Trire2:123786:c.6592T > C | p.Cys2198Arg |
| | | Trire2:123786:c.6337G > A | p.Val2113Ile |
| | | Trire2:123786:c.6295A > G | p.Thr2099Ala |
| | | Trire2:123786:c.6221G > A | p.Gly2074Asp |
| | | Trire2:123786:c.6196C > A | p.Gln2066Lys |
| | | Trire2:123786:c.6142C > T | p.Pro2048Ser |
| | | Trire2:123786:c.6119C > T | p.Ala2040Val |
| | | Trire2:123786:c.5949A > C | p.Lys1983Asn |
| | | Trire2:123786:c.5777A > G | p.Lys1926Arg |
| | | Trire2:123786:c.5752A > G | p.Ile1918Val |
| | | Trire2:123786:c.5662G > C | p.Ala1888Pro |
| | | Trire2:123786:c.5639T > C | p.Val1880Ala |
| | | Trire2:123786:c.5624G > A | p.Arg1875Lys |
| | | Trire2:123786:c.5566G > A | p.Val1856Ile |
| | | Trire2:123786:c.5542G > A | p.Val1848Ile |
| | | Trire2:123786:c.5447T > C | p.Val1816Ala |
| | | Trire2:123786:c.5377A > G | p.Asn1793Asp |
| | | Trire2:123786:c.4828A > G | p.Ile1610Val |
| | | Trire2:123786:c.4691G > A | p.Arg1564Gln |
| | | Trire2:123786:c.4664A > G | p.Glu1555Gly |
| | | Trire2:123786:c.4608A > C | p.Glu1536Asp |
| | | Trire2:123786:c.4502C > T | p.Ala1501Val |
| | | Trire2:123786:c.4415T > C | p.Leu1472Pro |

TABLE 5-continued

List of genes identified by the knock-out strategy as related to mating impairment of *Trichoderma reesei* QM6a

| SEQ. ID. No. | Trire2 Current Data Base Annotation | Coding Region Change | Amino Acid Change |
|---|---|---|---|
| | | Trire2:123786:c.4403C > T | p.Ala1468Val |
| | | Trire2:123786:c.4258T > A | p.Ser1420Thr |
| | | Trire2:123786:c.4193C > T | p.Ser1398Leu |
| | | Trire2:123786:c.4192T > C | p.Ser1398Pro |
| | | Trire2:123786:c.4138C > A | p.His1380Asn |
| | | Trire2:123786:c.4093A > G | p.Ile1365Val |
| | | Trire2:123786:c.3988A > G | p.Thr1330Ala |
| | | Trire2:123786:c.3938T > C | p.Val1313Ala |
| | | Trire2:123786:c.3801T > A | p.His1267Gln |
| | | Trire2:123786:c.3763C > T | p.Pro1255Ser |
| | | Trire2:123786:c.3755A > G | p.Asn1252Ser |
| | | Trire2:123786:c.3661G > A | p.Ala1221Thr |
| | | Trire2:123786:c.3499A > G | p.Asn1167Asp |
| | | Trire2:123786:c.3438C > G | p.His1146Gln |
| | | Trire2:123786:c.3283A > T | p.Thr1095Ser |
| | | Trire2:123786:c.3206T > C | p.Val1069Ala |
| | | Trire2:123786:c.3172G > A | p.Val1058Ile |
| | | Trire2:123786:c.3147C > A | p.His1049Gln |
| | | Trire2:123786:c.2960T > C | p.Ile987Thr |
| | | Trire2:123786:c.2929A > G | p.Ser977Gly |
| | | Trire2:123786:c.2902A > T | p.Asn968Tyr |
| | | Trire2:123786:c.2899A > G | p.Asn967Asp |
| | | Trire2:123786:c.2892G > T | p.Glu964Asp |
| | | Trire2:123786:c.2795C > T | p.Ala932Val |
| | | Trire2:123786:c.2623T > G | p.Cys875Gly |
| | | Trire2:123786:c.2614A > G | p.Arg872Gly |
| | | Trire2:123786:c.2593A > G | p.Ile865Val |
| | | Trire2:123786:c.2564A > T | p.His855Leu |
| | | Trire2:123786:c.2551G > A | p.Ala851Thr |
| | | Trire2:123786:c.2530A > G | p.Asn844Asp |
| | | Trire2:123786:c.2527G > T | p.Asp843Tyr |
| | | Trire2:123786:c.2503C > A | p.Arg835Ser |
| | | Trire2:123786:c.2477C > A | p.Thr826Lys |
| | | Trire2:123786:c.2263A > C | p.Ile755Leu |
| | | Trire2:123786:c.2206C > G | p.His736Asp |
| | | Trire2:123786:c.2075C > T | p.Thr692Ile |
| | | Trire2:123786:c.1986T > G | p.Asp662Glu |
| | | Trire2:123786:c.1873G > A | p.Ala625Thr |
| | | Trire2:123786:c.1857C > A | p.Asp619Glu |
| | | Trire2:123786:c.1808C > T | p.Thr603Ile |
| | | Trire2:123786:c.1793A > G | p.Asn598Ser |
| | | Trire2:123786:c.1699T > G | p.Phe567Val |
| | | Trire2:123786:c.1581A > C | p.Lys527Asn |
| | | Trire2:123786:c.1525A > C | p.Ile509Leu |
| | | Trire2:123786:c.1457C > A | p.Pro486Gln |
| | | Trire2:123786:c.1325A > G | p.His442Arg |
| | | Trire2:123786:c.1315T > A | p.Ser439Thr |
| | | Trire2:123786:c.1313G > A | p.Arg438Lys |
| | | Trire2:123786:c.1279A > G | p.Asn427Asp |
| | | Trire2:123786:c.1221C > G | p.Ser407Arg |
| | | Trire2:123786:c.1209A > C | p.Glu403Asp |
| | | Trire2:123786:c.1172A > G | p.Glu391Gly |
| | | Trire2:123786:c.1159A > G | p.Lys387Glu |
| | | Trire2:123786:c.1140C > G | p.Ile380Met |
| | | Trire2:123786:c.1085A > T | p.Asp362Val |
| | | Trire2:123786:c.1059C > G | p.Asn353Lys |
| | | Trire2:123786:c.1057A > G | p.Asn353Asp |
| | | Trire2:123786:c.1052T > G | p.Val351Gly |
| | | Trire2:123786:c.1049T > G | p.Val350Gly |
| | | Trire2:123786:c.1028C > A | p.Thr343Asn |
| | | Trire2:123786:c.1027A > C | p.Thr343Pro |
| | | Trire2:123786:c.1019A > C | p.Tyr340Ser |
| | | Trire2:123786:c.1018T > C | p.Tyr340His |
| | | Trire2:123786:c.979A > G | p.Ile327Val |
| | | Trire2:123786:c.973A > C | p.Ser325Arg |
| | | Trire2:123786:c.875C > T | p.Ser292Leu |
| | | Trire2:123786:c.764C > G | p.Ala255Gly |
| | | Trire2:123786:c.746T > A | p.Ile249Asn |
| | | Trire2:123786:c.743T > C | p.Leu248Pro |
| | | Trire2:123786:c.673A > G | p.Thr225Ala |
| | | Trire2:123786:c.656A > G | p.Asp219Gly |
| | | Trire2:123786:c.618A > C | p.Glu206Asp |
| | | Trire2:123786:c.547G > T | p.Gly183Cys |
| | | Trire2:123786:c.500A > G | p.Asn167Ser |
| | | Trire2:123786:c.499A > G | p.Asn167Asp |

TABLE 5-continued

List of genes identified by the knock-out strategy as related to mating impairment of *Trichoderma reesei* QM6a

| SEQ. ID. No. | Trire2 | Current Data Base Annotation | Coding Region Change | Amino Acid Change |
|---|---|---|---|---|
| | | | Trire2:123786:c.446C > G | p.Ser149Cys |
| | | | Trire2:123786:c.365A > G | p.Gln122Arg |
| | | | Trire2:123786:c.362G > A | p.Gly121Asp |
| | | | Trire2:123786:c.353A > C | p.Gln118Pro |
| | | | Trire2:123786:c.346A > G | p.Asn116Asp |
| | | | Trire2:123786:c.313G > A | p.Val105Ile |
| | | | Trire2:123786:c.292G > A | p.Glu98Lys |
| | | | Trire2:123786:c.289A > G | p.Ile97Val |
| | | | Trire2:123786:c.222T > A | p.Asn74Lys |
| | | | Trire2:123786:c.220A > G | p.Asn74Asp |
| | | | Trire2:123786:c.214T > G | p.Cys72Gly |
| | | | Trire2:123786:c.176G > A | p.Gly59Asp |
| | | | Trire2:123786:c.94G > A | p.Asp32Asn |
| | | | Trire2:123786:c.73A > T | p.Lys25* |
| | | | Trire2:123786:c.47T > C | p.Ile16Thr |
| | | | Trire2:123786:c.32C > T | p.Thr11Met |
| | | | Trire2:123786:c.16G > A | p.Ala6Thr |
| 146/147 | 111418 | unknown protein | Trire2:111418:c.711T > G | p.His237Gln |
| | | | Trire2:111418:c.871C > T | p.Pro291Ser |
| 148/149 | 68889 | PDR-type ABC transporters | Trire2:68889:c.204T > A | p.Asn68Lys |
| | | | Trire2:68889:c.377A > G | p.Glu126Gly |
| | | | Trire2:68889:c.853T > C | p.Ser285Pro |
| | | | Trire2:68889:c.953C > G | p.Thr318Ser |
| | | | Trire2:68889:c.1028G > T | p.Arg343Leu |
| | | | Trire2:68889:c.1071G > C | p.Gln357His |
| | | | Trire2:68889:c.1511T > C | p.Ile504Thr |
| | | | Trire2:68889:c.1847A > G | p.Lys616Arg |
| | | | Trire2:68889:c.1957G > T | p.Ala653Ser |
| | | | Trire2:68889:c.3100C > T | p.Pro1034Ser |
| | | | Trire2:68889:c.3535G > A | p.Val1179Ile |
| | | | Trire2:68889:c.3897G > C | p.Glu1299Asp |
| | | | Trire2:68889:c.3974G > A | p.Arg1325Lys |
| 152/153 | 124104 | unknown protein | Trire2:124104:c.4819G > A | p.Ala1607Thr |
| | | | Trire2:124104:c.4260C > A | p.Asn1420Lys |
| | | | Trire2:124104:c.4259A > T | p.Asn1420Ile |
| | | | Trire2:124104:c.4022G > A | p.Arg1341Lys |
| | | | Trire2:124104:c.3749C > T | p.Pro1250Leu |
| | | | Trire2:124104:c.3722T > C | p.Ile1241Thr |
| | | | Trire2:124104:c.3694A > C | p.Ile1232Leu |
| | | | Trire2:124104:c.3668A > G | p.Lys1223Arg |
| | | | Trire2:124104:c.3655G > A | p.Ala1219Thr |
| | | | Trire2:124104:c.3625G > A | p.Val1209Ile |
| | | | Trire2:124104:c.3566A > C | p.His1189Pro |
| | | | Trire2:124104:c.3092T > A | p.Val1031Glu |
| | | | Trire2:124104:c.2884C > T | p.Leu962Phe |
| | | | Trire2:124104:c.2880A > C | p.Glu960Asp |
| | | | Trire2:124104:c.2663G > A | p.Gly888Glu |
| | | | Trire2:124104:c.2600A > C | p.Lys867Thr |
| | | | Trire2:124104:c.2516C > T | p.Thr839Ile |
| | | | Trire2:124104:c.2407T > A | p.Cys803Ser |
| | | | Trire2:124104:c.2074C > T | p.Leu692Phe |
| | | | Trire2:124104:c.1343T > C | p.Val448Ala |
| | | | Trire2:124104:c.1127T > C | p.Val376Ala |
| | | | Trire2:124104:c.866T > C | p.Val289Ala |
| | | | Trire2:124104:c.181T > C | p.Ser61Pro |
| | | | Trire2:124104:c.175G > A | p.Val59Ile |

*This nucleotide exchange occurs in a codon triplet affected by two consecutive mutations. Therefore only the amino acid resulting from combining both exchanges is given in the table.

Example 2

Identification of mutated genes as directly or indirectly associated with mating impairment in strains of *Trichoderma reesei* QM6a or strains derived thereof.

1. General

To identify genes that are directly or indirectly associated with the above mating impairment and non-functional in QM6a and its descendants, these genes were transformed individually or in pools of several genes into a *T. reesei* QM6a strain in which the MAT1-2 locus has been replaced by MAT1-1. The genes to be tested were cloned into a plasmid containing a geneticin resistance marker and transformed into the above said *T. reesei* QM6a MAT1-1 strain by protoplast transformation. Mitotically stable transformants were then tested for integration of the respective genes into the chromosomal DNA by PCR analysis. Positive transformants were then subjected to potential mating with *T. reesei* QM6a MAT1-2, and verified by the formation of fertile fruiting bodies (their fertility was tested by isolating ascospores and demonstrating that they were capable of mating with the opposite mating partner). The following experimental protocol may be used for any of the genes identified to be associated with mating impairment.

2. Preparation of Strains with Loss-of-Function in a Gene Associated with Mating Impairment Female sterility gene candidates were identified initially by a combination of classical genetics (crossing, backcrossing) and comparative genomic sequencing. The genomic differences between the mating competent strain obtained after backcrossing (CBS1/A8_02, MAT 1-1) and the mating deficient starting strain (QM6a, MAT 1-2) must, by definition contain the entirety of the required genes for functional complementation of mating. In addition the FS genes required must be shared by the endpoints of the 2 backcrossing lines (CBS1/A8_02, MAT 1-1 and CBS2/A8_11, MAT 1-1). Further the inactivation of FS genes in a mating competent background must debilitate functional mating. All these procedures were taken to arrive at a list of genes that when singly or co-introduced into *Trichoderma reesei* QM6a (MAT 1-1) will reconstitute mating competence.

Since it is possible that more than a single gene associated with mating has become non-functional in *T. reesei* QM6a, and consequently the complementation with single genes would not lead to a gain of mating functionality, knock-out strains for all candidate genes were prepared in a mating competent *T. reesei* QM6a derivative. In this way any genes essential for mating would be identified whether solely responsible for mating deficiency in QM6a or being part of a group of inactivated essential mating genes. To this end, a tku70 deleted version of strain CBS1/A8_02 (MAT1-1) was generated. The knockout of the tku70 gene was achieved by crossing of strain CBS1/A8_02 (MAT1-1) with a tku70 deleted version of strain QM9414 (a mating incompetent descendant of *T. reesei* QM6a) which carries the resistance to pyrithiamin hydrobromide (ptrA) as selection marker. Descendants of this crossing were screened for the presence of the MAT1-1 locus and the tku70 deletion. The resultant strain will in the following be called CBS1/A8_02 Δtku70.

Deletion cassettes consisting of 1.0 to 1.5 kb fragments of the gene-specific flanking regions interrupted by the gene conferring resistance to hygromycin (hph) under the *T. reesei* gpd promoter and terminator were assembled by yeast recombinational cloning (Colot et al. 2006). Individual flanking regions of candidate genes were amplified using oligonucleotides (100) 5F+5R as well as 3F+3R from genomic DNA of strain CBS 999.97/MAT1-1 with Phusion Polymerase (Thermo Fisher). The hph gene including the gpd promoter and terminator sequence (2.7 kb) was amplified by PCR from the plasmid pLHhph (Hartl et al. 2007) using the primers hphF and hphR (hphF: GGATCCGA-GAGCTACCTTAC (SEQ ID NO: 175), hphR: CTC-GAGGGTACTATGGCTTA (SEQ ID NO: 176)). By PCR an approximately 19 bp sequence was introduced at the flanking region to overlap with either the yeast shuttle vector pRS426 (URA+) or the hph marker gene allowing homologous recombination. For amplification of all fragments a touchdown PCR program with annealing temperatures ranging from 62° C. to 58° C. was used. Sequences of the oligonucleotides used are given in Table 6).

In this way genes that when knocked-out did not abolish mating competence in mating competent strain CBS1/A8_02 Δtku70 (MAT 1-1) were identified as non-essential for mating and consequently removed from the list of candidate genes for female sterility in *Trichoderma reesei*. To this end four genes were identified, the deletion of which resulted in mating inability. The genes are functional homologues of the genes having SEQ ID NOs: 40, 110, 112 and 134. For transformants having a knock-out of the functional gene corresponding to the genes of SEQ ID NO: 40, SEQ ID NO: 110, SEQ ID NO: 112 and SEQ ID NO: 134 no mating was found.

TABLE 6

Sequences of primers used to amplify the 5' and 3' inserts for the construction of knockout vectors to delete genes with transcript ID 67350, 76887, 105832 and 59270.

| Gene ID | | Primer sequence |
|---|---|---|
| Trire2_67350 | 5F | GTAACGCCAGGGTTTTCCCAGTCACGACGCCTAGCCTGCTCTT ATTACC (SEQ ID NO: 177) |
| | 5R | CATATTGATGTAAGGTAGCTCTCGGATCCCAAGCTCGTGAGAC AGTACC (SEQ ID NO: 178) |
| | 3F | TATTCCATCTAAGCCATAGTACCCTCGAGCCTTTGTCTTCTCTT CGTTCG (SEQ ID NO: 179) |
| | 3R | GCGGATAACAATTTCACACAGGAAACAGCGAGATGACACTTCA GGGAGG (SEQ ID NO: 180) |
| Trire2_76887 | 5F | GTAACGCCAGGGTTTTCCCAGTCACGACGGATGGTAGTTTCTT GGCTGC (SEQ ID NO: 181) |
| | 5R | CATATTGATGTAAGGTAGCTCTCGGATCCTAAGAAGAGCCTTCT CGTCC (SEQ ID NO: 182) |
| | 3F | TATTCCATCTAAGCCATAGTACCCTCGAGCTTGGAGAGGTACT CAGAGC (SEQ ID NO: 183) |
| | 3R | GCGGATAACAATTTCACACAGGAAACAGCGACAAGGAGCAGAA AAGACG (SEQ ID NO: 184) |
| Trire2_105832 | 5F | GTAACGCCAGGGTTTTCCCAGTCACGACGCATACCATCGTGTG TACTGG (SEQ ID NO: 185) |
| | 5R | CATATTGATGTAAGGTAGCTCTCGGATCCAGATCTAATACCCCA CCAGG (SEQ ID NO: 186) |
| | 3F | TATTCCATCTAAGCCATAGTACCCTCGAGTGTATGCTTTGGCCG CTGAC (SEQ ID NO: 187) |
| | 3R | GCGGATAACAATTTCACACAGGAAACAGCCTACATACCTACAT GCGACG (SEQ ID NO: 188) |

TABLE 6-continued

Sequences of primers used to amplify the 5' and 3' inserts for the construction of knockout vectors to delete genes with transcript ID 67350, 76887, 105832 and 59270.

| Gene ID | | Primer sequence |
|---|---|---|
| Trire2_59270 | 5F | GTAACGCCAGGGTTTTCCCAGTCACGACGGAGGATCAACAGTC TACAGC (SEQ ID NO: 189) |
| | 5R | CATATTGATGTAAGGTAGCTCTCGGATCCACCACCCCACTAAG ATAAGG (SEQ ID NO: 190) |
| | 3F | TATTCCATCTAAGCCATAGTACCCTCGAGGGTAGGTAGGTAGC TCATGC (SEQ ID NO: 191) |
| | 3R | GCGGATAACAATTTCACACAGGAAACAGCGAGTGTCATGTGAG ACAACC (SEQ ID NO: 192) |

Example 3

Preparation of Strains Complemented with a Gene(s) Associated with Mating Impairment To obtain a QM6a/MAT1-1 strain being capable of performing successful sexual reproduction using QM6a/MAT1-2 as mating partner, strain QM6a/MAT1-1 was transformed with plasmids containing the functional variant of the gene(s) identified in association with mating impairment in strain *T. reesei* QM6a/MAT1-2.

The strain QM6a/MAT1-1 which was used for gene complementation with the identified candidate genes Trire2_67350, Trire2_76887, Trire2_105832 and Trire2_59270, was constructed by transforming a gene replacement cassette consisting of the MAT1-1 locus, a marker gene and a 3' flanking region for homologous integration in strain *T. reesei* QM6a/MAT1-2. The MAT1-1 locus including the 3' region was amplified from strain CBS999.97 (MAT1-1) with Phusion Polymerase (Thermo Fisher) by using the primers MAT1-1_InFusion fw (GTGCTGGAATTCAGGCCTGGCTTGATGCTGCTAAC-CTTC (SEQ ID NO: 193)) and MAT1-1_InFusuion rv (TCTGCAGAATTCAGGCCTACTCCGCAAGAT-CAAATCCG (SEQ ID NO: 194)). The amplicon was cloned in the PCR blunt vector (pCR blunt, Invitrogen) using the InFusion HD cloning system (Infusion HD Cloning System CE, Clontech). As selection marker the gene conferring resistance to hygromycin (hph) under the *T. reesei* gpd promoter and terminator was used. The hph cassette was amplified by PCR from the plasmid pLHhph (Hartl et al. 2007) using the primers hph_Avrll_fw (GTCCACA-GAAGAGCCTAGGACCTCTTCGGCGATACATACTC (SEQ ID NO: 195)) and hph_Avrll_rv (GGCTTTCACG-GACCCTAGGTTGGAATCGACCTTGCATG (SEQ ID NO: 196)). The plasmid containing the MAT1-1 locus including the 3' flanking region was then digested by Avrll (Thermo Fisher) to insert the hph cassette between the mat1-1-3 gene and the 3' flanking region of the MAT1-1 locus by using the InFusion cloning system (Infusion HD Cloning System CE, Clontech). For the mating type exchange in *T. reesei* strain QM6a/MAT1-2 the gene replacement cassette was amplified from the plasmid by PCR using primers 1-2_replace_cassette_fw (TGGAAC-GACTTTGTACGCAC (SEQ ID NO: 197)) and 1-2_replace_cassette_rv (GGCACAAGAGGACAGACGAC (SEQ ID NO: 198)). The gene replacement cassette was then transformed by protoplast transformation (Gruber et al., 1990). For each transformation 10 µg of DNA were used. The resultant strain will in the following be called QM6a/MAT1-1.

To complement the mating deficiency of strain QM6a the wildtype (CBS999.97) allels of the newly identified candidate genes, Trire2_67350, Trire2_76887 and Trire2_105832, were introduced ectopically in strain QM6a/MAT1-1.

For ectopic gene integration plasmids were constructed containing the wildtype (CBS999.97) allel of the candidate genes followed by the gene conferring resistance to Geneticin disulfate G418 (nptll). As vector for the transformation the plasmid pPki-Gen which was available in the vector collection at the Technical University of Vienna, Institute of Chemical Engineering, Research Area Gene Technology and Applied Biochemistry (unpublished), was chosen. This plasmid is derived from the plasmid pRLMex30 (Mach et al. 1994). The plasmid pRLMex30 was digested with XbaI and HindIII (Thermo Fisher Scientific/Fermentas, St. Leon-Rot, Germany), removing the hph coding region and cbh2 terminator region (2066 bp) thereby leaving the pki1 promoter. Next a 2.4 kb fragment containing ~800 bp of the trpC promoter, the nptll coding region and ~700 bp of the trpC terminator was amplified from pII99 (Namiki et al. 2001) using the primers GenFW (CCTCTTAACCTCTAGACG-GCTTTGATTTCCTTCAGG) (SEQ ID NO: 156) and GenRV (TGATTACGCCAAGCTTGGATTAC-CTCTAAACAAGTGTACCTGTG) (SEQ ID NO: 157). The two fragments were joined by InFusion recombination (Clontech, USA) resulting in the plasmid pPki-Gen. The nptll gene confers resistance to Geneticin disulfate G418 which was then used to select fungal transformants.

In a further step, the plasmid pPki-Gen was digested with EcoRI and XbaI (Thermo Fisher Scientific/Fermentas, St. Leon-Rot, Germany) to remove the pki1 promoter (~740 bp). The genes identified to be responsible for mating impairment (i.e. Trire2_67350, Trire2_76887, Trire2_105832 and 59270) were amplified from strain CBS999.97/MAT1-1 by PCR and introduced in the cut vector by In-Fusion recombination (Clontech, USA). Oligonucleotides used for the amplification of the respective genes are given in Table 7. The complete sequences of the resultant plasmids are given in SEQ ID NOs: 212 to 215 and in FIGS. 5 to 8.

TABLE 7

Sequences of primers used to amplify the wildtype allels of candidate genes from strain CBS999.97 for the construction of vectors to complement the mating deficiency of strain T. reesei QM6a.

| Gene ID | | Primer sequence |
|---|---|---|
| Trire2_67350 | repI_Trire67350_ infusion fw | TAAAACGACGGCCAGTGAATTCAATAAAGACGGCCTGGAA AC (SEQ ID NO: 199) |
| | repI_Trire67350_ infusion rv | AGGAAATCAAAGCCGTCTAGATTCCGCATACCACCTACTT G (SEQ ID NO: 200) |
| Trire2_76887 | repI_Trire76887_ infusion fw | TAAAACGACGGCCAGTGAATTCTTCTCTGATCGTTG GGCTATG (SEQ ID NO: 201) |
| | repI_Trire76887_ infusion rv | AGGAAATCAAAGCCGTCTAGATGCCTCGATAAGACA AAGTGC (SEQ ID NO: 202) |
| Trire2_10583 2 | repI_Trire105832_ infusion fw | TAAAACGACGGCCAGTGAATTCATGTAGAGCGGCAC CAAAGAGC (SEQ ID NO: 203) |
| | repI_Trire105832_ infusion rv | AGGAAATCAAAGCCGTCTAGACAATCGCGTGGCTTT CGTTC (SEQ ID NO: 204) |
| Trire2_59270 | repI_Trire59270_ infusion fw | TAAAACGACGGCCAGTGAATTCCGCCAGGTTGATCTTGTT CTAC (SEQ ID NO: 205) |
| | repI_Trire59270_ infusion rv | AGGAAATCAAAGCCGTCTAGATCGAAGTGTAGGCTGGAAT GAG (SEQ ID NO: 206) |

Strain QM6a/MAT1-1 was then transformed via protoplast transformation (Gruber et al., 1990) with the circular plasmid containing the respective candidate gene(s). Since it was not known whether a single gene or the combination of the respective candidate genes was responsible for the mating deficiency, the candidate genes were transformed singly as well as in combination. Per transformation reaction 10 μg of circular plasmid were used. Of a total of 6 ml protoplast suspension each one ml of protoplast suspension was added to 4 ml of overlay medium containing Geneticinsulfate G418 at a concentration of 100 μg/ml. The respective solution was then poured on agar plates containing malt extract agar (2% w/v) to which Geneticinsulfate G418 had been added to a concentration of 100 μg/ml to select fungal transformants. Plates were incubated at 28° C. in darkness for 7 days. Potential transformants were then transferred to new plates containing Potato Dextrose Agar (Difco, USA) with 100 μg/ml of Geneticinsulfate G418 to select fungal transformants.

Mitotically stable transformants were then tested for integration of the respective gene(s) into chromosomal DNA by PCR analysis. Chromosomal DNA was extracted according to Liu et al. (2000). To test for the positive integration of the genes a gene specific primer and a primer binding within the nptII cassette were used. Sequences thereof are given in Table 8.

Positive transformants were then subjected to mating assays with T. reesei QM6a MAT1-2. Mating is verified by the formation of fertile fruiting bodies. Their fertility is tested by isolating ascospores and demonstrating that they, upon germination and growing into a mycelium, are capable of mating with the opposite mating partner.

To verify the restoration of the mating ability positive transformants are tested in mating assays. Mating assays are performed on PDA (Difco™, potato dextrose agar) plates where T. reesei wildtype strain QM6a/MAT1-2 (ATCC 13631) is co-cultured with positive transformants of T. reesei QM6a/MAT1-1 complemented with the repaired candidate gene(s). Plates are kept at room temperature (20-23° C.) exposed to the natural circadian light cycle to promote fruiting body formation. Their fertility is tested by isolating ascospores from the fruiting bodies and demonstrating that colonies grown from them are capable of mating with the opposite mating partner.

Table 9 shows the correlation of the respective female sterility gene and the corresponding corrected and thus functional sequence.

TABLE 8

Sequences of primers used for genotyping of strain QM6a/MAT1-1 complemented with the wildtype allels of the respective female sterility candidate genes.

| Gene ID | | Primer sequence |
|---|---|---|
| Trire2_67350 | 67350_fw | AATAAAGACGGCCTGGAAAC (SEQ ID NO: 207) |
| Trire2_76887 | 76887_fw | TTCTCTGATCGTTGGGCTATG (SEQ ID NO: 208) |
| Trire2_105832 | 105832_fw | ATGTAGAGCGGCACCAAAGAGC (SEQ ID NO: 209) |
| Trire2_59270 | 59270_fw | CGCCAGGTTGATCTTGTTCTAC (SEQ ID NO: 210) |
| | in geneticin rv | ATCCCGAAAGCATCACCG (SEQ ID NO: 211) |

| Gene ID | Sequence associated with mating impairment | Sequence associated with mating competence |
|---------|---------------------------------------------|---------------------------------------------|
| 105832  | SEQ ID NO: 40/41                            | Coding sequence of SEQ ID NO: 220 or of SEQ ID NO: 224 |
| 76887   | SEQ ID NO: 110/111                          | Coding sequence of SEQ ID NO: 218 or of SEQ ID NO: 228 |
| 59270   | SEQ ID NO: 112/113                          | Coding sequence of SEQ ID NO: 222 or of SEQ ID NO: 230 |
| 67350   | SEQ ID NO: 134/135                          | Coding sequence of SEQ ID NO: 216 or of SEQ ID NO: 226 |

REFERENCES

Altschul S F., Gish W., Miller W., Myers E W. and Lipman D J. (1990) Basic local alignment search tool. J. Mol. Biol. 215, pp. 403-410.

Chang S. and Staben C. (1994) Directed Replacement of mt A by mt a-1 Effects a Mating Type Switch in *Neurospora crassa*. Genetics 138, pp. 75-81.

Colot H V, Park G, Turner G E, Ringelberg C, Crew C M, et al. (2006) A high throughput gene knockout procedure for *Neurospora* reveals functions for multiple transcription factors. Proc Natl Acad Sci USA 103: 10352-10357.

Druzhinina I., Komon-Zelazowska M., Atanasova L., Seidl V. and Kubicek C. (2010) Evolution and Ecophysiology of the Industrial Producer *Hypocrea jecorina* (Anamorph *Trichoderma reesei*) and a New Sympatric Agamospecies Related to It. PLoS ONE 5(2) e9191

Fazenda et al. (2008) Submerged culture fermentation of "higher fungi": the macrofungi. Advances in Microbiology 63, pp. 33-103.

Gruber, F., J. Visser, C. P. Kubicek, and L. H. de Graaff. 1990. The development of a heterologous transformation system for the cellulolytic fungus *Trichoderma reesei* based on a pyrG-negative mutant strain. Curr Genet 18:71-76.

Guangtao, Z., L. Hartl, A. Schuster, S. Polak, M. Schmoll, T. Wang, V. Seidl B. Seiboth. 2009. Gene targeting in a nonhomologous end joining deficient *Hypocrea jecorina*. Journal of Biotechnology 139, pp. 146-151.

Husemann P, Stoye J. (2010) r2cat: synteny plots and comparative assembly. Bioinformatics 26(4), pp. 570-571.

Kang S., Chumley F. and Valent B. (1994) Isolation of the Mating-Type Genes of the Phytopathogenic Fungus *Magnaporthe grisea* Using Genomic Subtraction. Genetics 138, pp. 289-296.

Kuhls K, Lieckfeldt E, Samuels G J, Kovacs W, Meyer W, et al. (1996) Molecular evidence that the asexual industrial fungus *Trichoderma reesei* is a clonal derivative of the ascomycete *Hypocrea jecorina*. PNAS 93, pp. 7755-7760.

LeCrom et al. (2009) Tracking the roots of cellulase hyperproduction by the fungus *Trichoderma reesei* using massively parallel DNA sequencing. PNAS 106 (38), pp. 16151-16156.

Liu D., Coloe S., Baird R. and Pedersen J. (2000). Rapid Mini-Preparation of Fungal DNA for PCR. Journal of Microbiology, Vol. 38(1), p. 471

Mach R L, Schindler M, Kubicek C P (1994) Transformation of *Trichoderma reesei* based on hygromycin B resistance using homologous expression signals. Curr Genet 25: 567-570

Martinez D. et al. (2008); Genome Sequence Analysis of the Cellulolytic Fungus *Trichoderma reesei* (syn. *Hypocrea jecorina*) Reveals a Surprisingly Limited Inventory of Carbohydrate Active Enzymes. Nature Biotechnology 26, pp. 553-560

Namiki, F., Matsunaga, M., Okuda, M., Inoue, I., Nishi, K., Fujita, Y., and Tsuge, T. (2001). Mutation of an arginine biosynthesis gene causes reduced pathogenicity in *Fusarium oxysporum* f. sp. *melonis*. Mol. Plant-Microbe Interact. 14, 580-584.

Picard M., Debuchy R. and Coppin E. (1991) Cloning the Mating Types of the Heterothallic Fungus *Podospora anserina*: Developmental Features of Haploid Transformants Carrying Both Mating Types. Genetics 148, pp. 539-547

Punt et al. (2002) Filamentous fungi as cell factories for heterologous protein production. TRENDS in Biotechnology 20(5), pp. 200-206.

Rissman A I, Mau B, Biehl B S, Darling A E, Glasner J D, Perna N T. (2009) Reordering contigs of draft genomes using the Mauve aligner. Bioinformatics 25(16), pp. 2071-2073.

Seidl et al., 2009: Sexual development in the industrial workhorse *Trichoderma reesei*. PNAS 106(33), pp. 13909-13914.

WO 2011/095374

SEQUENCE LISTING (231 sequences)

SEQ ID NO: 1 - DNA, 39 bp, artificial sequence
  MAT1-1 fuer pyr4 InFusuion fw
gtgctggaattcaggcctggcttgatgctgctaaccttc

SEQ ID NO: 2 - DNA, 38 bp, artificial sequence
  MAT1-1 fuer pyr4 InFusuion rv
tctgcagaattcaggcctactccgcaagatcaaatccg

SEQ ID NO: 3 - DNA, 41 bp, artificial sequence
  hph_AvrII_fw
gtccacagaagagcctaggacctcttcggcgatacatactc

SEQ ID NO: 4 - DNA, 38 bp, artificial sequence
  hph_AvrII_rv
ggctttcacggaccctaggttggaatcgaccttgcatg

SEQ ID NO: 5 - DNA, 20 bp, artificial sequence
  1-2_replace_ cassette_fw
tggaacgactttgtacgcac

SEQ ID NO: 6 - DNA, 20 bp, artificial sequence
  1-2_replace_ cassette_rv
ggcacaagaggacagacgac

SEQ ID NO: 7 - DNA, 15853 bp, artificial sequence
  MAT1-2 replacement vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacgcgttagaatactcaagctatgcatcaagcttggtaccgagctcggatccactagtaacggccgccagtgtgctggaattcaggggcttgatgctgctaaccttcaatgtcaagctttcgtcaacactccagcaggctcaggatctattcgccatctctctataaacgcaattgctgaccctaccttgatgatattgtacatggccttgtcctgctggctctccccgctctcgagattacatttacatttttccatcgcacgccatgcatcgaagcatctacctacttggacgctggcttccatccggctcgcctggcctgctctttgtcaatggcctccttctcttccagatacgtctccaacgtcgtgggcgccgttgttccccaaactctccacggacccgcctcgaacgtaactgcgttgacctgccttgagagcaccacatattccaccttgtcctggatcttgacgcttccggggatggtttctccggtagatgcgtcatatcgggacacctgctgcgtagaggagatggcaacgaccgcctgctcagtcatgaggttcttgtcgtacatgttgatctggtgaatctggtgtgccgttcttttagggtagaagagcgggttgttgtacttggtcacctcgaagtggactcgctctctggggttacggcgatcgatagccgcaatgagcttctttgcgaaatcgttgacgcagatcctctccagagtcgccttatctcccgcggcaaacgcttccagaacttcctggtacagagccttggctgtgggcgcaatcttgccgcgccgagctttccactggggtcgagtcgtccagttgggcatggatttcagcttgaagttgagcaaagaaacggtctcaatcacccagtgcctcaaccggtgccattggtattgcgcaaagtccgcagggttcagcggcaggcgagacagcggaagggatacgaacgtgcctaaaggttagggattcgatgtcagcgagagccagcaagagccagcagaacacggcagaggcagcctagcctgtgcctcctggcaggattgagcgcaaagagcgtgtacgaacctggaaacagcggcccccctccatccttgaagtattccgcgtttgccatcttctgcagctgcgagatgctctgctccttcgtcatcttgctggagcctgcgcgagccgcgcgatccatctctctcattgtcctgctccgggagggctgtgttgcatattgccggaccatctgcgcagccaatggccttgcggcgcatcttgagacagagtttgctgtgccgtaacggagagccggcgccgtgagggaccgcatcgtgggagcgtgagacatggcggcgagctgagcagtggaatctggggcgatacgagcgcaactgactgtctccctttgacaggctgtgctattttcgagcgacggaagagaacggcaacaggctttcacatcgccatcgccagcatcatcctacggaattcgacgtctctaaaatgccggcatggcgttgaacttttgtcgatgacggcgtagaaagaggacgggttaacgataacccgaatgccggcgcacttctctctctctctctctcacggccgggtccggacaaccgtttgaacgtccctcacctcccgaagagggccgagcatcgcttcttcttgcgcattgggcaaagcaggattgacccgaagctttcctgctgcgtgatccatatagctcagattctctcatgtcactacactttaggtgagccgattggctcgtccgctgaaatcctgccagcctcgatataccccgtcagggcttcttactctcctgctctcgctctgcccgtgatgatgagagccacgcagccgatgctcgccaagggcttcctggcgcggagctttgacgagctcaagaggcgatccagcataggtacagtgccttacccaggagcatgtacacttatctcgccgcccgcggggggctggagagacgatgtgcattatattgacccggctcagctaacgtttgcgtcgccagcatggaacctcgacgctgtcaaaggcccttcaggcccccgcgaactctacgacttccacagcgctgattcggtcagcaactgcatcgtcatgtccgacactctaattggcggctcctctaccagccacctcgactttattactcctacgtcttcgtcctcggcgcaaatttcggcatcgacgccggcaccctcctcttacgcgcgcttctacggccacatctcaacttcactgccttcagatcgcctggcaatccagcgaacgggctatgctgcgtttcggacgccggatcagccgcctaccgcctttggtcgctccgtctgggatattgatccgtatacatatcttgcattgcgagtcaagtccgatggaagggcatactatgtcaatgtccagacagagagcgttgagccgaccgatctgcaccagcaccggctgttcgcaaaacgtcctgggcaatgggagacggtcctcattcgatggaacgactttgtacgcacaaatcacggcttcgttgtcgagcctcagacggagctgctgagacaaagagtccacaccgtaggcattgggctgacggatcgcgtggaggggccctttgagctttgcattgagcgggtttgggcgacgaacggggcggaggagaaggctgcggcgcagggaacgcaggatggggaattgaagaacaggaaaggtgagaagattcagtggtgagcaatagcggcaccttcgtggatagtgctctgagaggaatgaccaaaggggtctcttgatccagaacacatcggtgaccatcgtttggccagcaaggaagtgactgttgattggtgctctcctggttctcttcgacttctgcgttgtgtataggggtggcagtgtccggcggtgagctgctcagatttttgcctcggtctggcttgctggtcatcgaacactggcttgaccagtctttacttccgatgccgtcaactgaagctgattctgatccacctgcgttacgacgtgggcaatttcgtagggaatgtcgcttagatgaggtgacactaccttgtattactcatgtagctaggcgaaatatctcaaacttaccttacaattaccccatgtaagctgcgctctgtcatggcttcatgttacctgtctcgtgaggagttgaataaggtacctagtgagtatcaggaagatcaagcaggtagcaagcagcgagtgaagagcactacctatgcattggatgcggcacactctgcgtaatgtctagatattcgaattctgatgggtatcattaacctcgtgtcgaaaccaggcttgggcctgctaccatggctctcctatgctacctaaagacaattgccaaaccatttcaaatttccgttcccccatgccgatatagtacaagcctgtatgtgaacgcaatgccgaatgagaaagaaaaaagagccgtgtcccccctgcccgctcccttgggtagtgcaccgacgtgtgagcatcgaggatcgtatcatcgggtcgcgcggtttagaaggtgtagaagaactcattgtgaggattgtactggttgttgggctgtggcaggccggcagcaggtattactactaggtaaggtactggagcattagtgacactggtaactcaaggtaataaagtagctgtcgagaacttgtgggggagacaaacctctatcgccctcgttctccttgtagcccagcatcttgtcaaagtcccaaggattgtcgaggtcgaacgtatcgctctcagtcatggtggcaaagtagtccagctgaggcatctcgggctggtatggctgtgcggccgtcgaagaggcgtagttgtaaatctgtcgtgggtccggataggcaaactgcagaggcaggtggctcactgcgttgaggtcctcgaccaggtgagacttgactccaagagccgcaacccttttctcttcgtaatggccgcctagaagctccttcgctgcttggaatggatctgcttcgacaactttcatgaactctgacttttctttggtcgaaatgactggcacagagctggtcgcggtagtcatgatgccgttgctgttggcgttcattcgatccatgaggttcatactatcatcaggaagatacccaacctggatgatagctgaaagaagatcattctctgtgttgggatggtcatccgagtccattggctgagcgatgctggcgccatcagcttgaaagagtctcggagatccagcatcatcctccactgaccagccgaaagatgagagatagatagaaggctccgtgattttcatgatggggcaagagacattgagaaaataggagagagacaccttgtctctgccgagttggtctctcacaaaggaatagactttggcgatcaaagcccatttattcctgtaggggtctttgttccagagagttgtgagaaatcccgatgcagtcttctgttggacttcaggaaaaagcctcagataataacctgccaggcactttagttaatagatttcaatcgaaccatgccggagccgctcacttctgaaagccatgaacgcattgagaggacgtttggctttatcagttgaagtctccgccccttgggtcgggatcaatgcagaggatgatgcatctccagaagtgttctgtttcatcgcttgattttgttgtgcgccgattccgagagacgtgaagtatgtattcgcgagttcgagcagcgtatcgtctctgagaaaatgcaagatctcgtccgtccgtagcaccgagaggtgcttttctaactcttccctggacatcatcttgccttagattcttgatgatgatgtgtttcctttcggtgcaaaaagcttattgactggtgaagttggaaggagagtgatggggtttatagaggaaggagctgagagaagtggtgggtgtgcctttacggctatggggtgaggattaagagagcctagtggggtgttgacatttcttggcccaacaacaatacggaacggtgtgtgagtgaaaagtgagctagcaaggaggggtggggtgggagagtgaatcgatgagccgctgtgaatttaccccaagctgagatctgcactagttcacaaattatgggctcaagcactcacttcaagaagtttcgcactagcactgctagtgtgtgccaggcagcttggggaactactgtacctacctgaggaacctacctacttacttgcctactaaggtacccaccatcttaaccttaggtactcataggcaagttcgatcgaaagtgaggcggctctaggtaggtgcttaccatgatacctagtaagcagttgggccaagagtacgtaggtaggtaggtaatcttaggtagtaggtaacgcaaggaatagcatcgctactcggacccacgttataagggttgtgacagtggaagtcggttaatttgaactccagaagatcatgaaaatcactgagcgctcggtgtatgttggtccacgaaacacctcaacctatgcatcatgtgccaatgtgttcttcctaagtacctactgaggtgctatatctacgtctacctaccgattgatccaggttcactactgggacaaatatgatggtaattcattcaattaccgcctggtgtatacctattgcgttcttcagagcgacaaaattgtaagcggaaaggtcatcatgaacagattttgctcaatctcgtcaggatcctctccgaatctcaatgccctgatagctgtcgtcaggaaaggaagtgtcaagttcccagttgggtcggaaatgggctttttaacctagaatgaacaatgtcagttacgtcgggcccagtcagtcaagtggtggaaatcagattttacttaccataggtagattgtaaaggtactcttggtccaaatgagttactgaagcagctgtctaagattttgtcagattagagtgcgatatgttaccagtagaacatacctccaaagcagggatcaaagccggatactcgcaacccgtttgtgctgctaggtcacgaaattgtttttcacattcttccaacgccaatcgggaccgtggacgatttgtctagaattaattagaattggaattatttggtggagaacttgaacacttgcctgatcgaatctggtacgaagagtcgagtagtaatctccaaaggctgaggtcaatatagccgcggaactcgggagcctgaagatgatgcggatatctcgcgatccgtcccctggtgatttcgggaaaatgggtcgacaggtattgttgatccatttattccagtgagagccgggaaccttcctacacggatgccagaaaggagctttgccccaatcagctcgtccaactttgctcagaagtcctttcccattgcgacaaagcctgatctcgtcgacatgtgcaccaaaatcaattcctggtggagttcctgcttcgtcgacagacttctgagcaagcctccatgccgactgaagaaacagcttgataccatcggtaccgggacaggcagatagcgcaggcctccaagcgttataggagggcatgcgcgaagagatcatataggcggcaaagagcatcgtagtggccccacaggaaacaagcgttgctacttgcaatttaggatctttgggcggaagccatacttctgtcgtcaagagcatagccatcagacctaagttgccgacgtaatgtttctcggcggcaaagtccctattccacgtagcgacaactgtgccatcttcgaacgttgcaatctcttcttctgaagatacaccctggtgtatatccctctcgaggatagacacagaacttgtgtaccaaagtgcgatcgctccctcaacggcaattatgggatcagcttcagtctgaacggcgacagttcgaagtcgcgcgatgatggggttgaatccttcccagaaagagagaagatgtttcatcactttcaaggactccgcgacgatatctgcaaactttacattagattcaatctcaaaactgcttcaagagtacgtacaatccatgcttggcggttgttggatgtccaacgattcattttcttgaaggaatatcttcatcgattcaaggcgaatgttggaaatatcggtttggggagcatcagactcaatgttcttccataaaggctcgaagctgcatatgttctccatttctggcgagattgtttgatacgcaatgttgaaatctaagagccaaagttgaatggcgaggataggatctttctcttcctgtacgtcttcgggcagtgttgatggtgatgttgctgttttttcccggtggccttcttttgtcttttgagtccgtcaattctttccatccttgtttctttccttgtgctcatgcagaacatggtgtgcgggtggggggctctgttttcacttctacctcacttttttttcattattcaatcagcaagcccgaaaacaccaacctccagcccgccataccctccaccctccgctccccagcccccaataacccggtccaagaaacagaaaaggaaatgaaaaaggcaggccttattcactcttttccttgcaccccaacctccggacatttcactgaggaatctctcaatatcaagaacaaccttttctttcctagcaattgttatctagttccaactcggcgcgttgatattaattatcttcattgttacccagacaaccacacctcccgcaaacacaccacaatgcagccgagatacctcaatgatcaggtgatggatactctaccagatattcctatgacgttcgtgagatgcgagacacagaagaatctccatgtctttattcccgaagcttttgatcttgacttggtcactactgtcgcagagaacttcaggtgagcaatcacacacagctttaggatgatcaagcccttactcttaatagtcgaaaggtccagcagccggtcagggtgttccatgatgaagcactgcaaaagttcagactttgtccagttcctgaagggtccactgtgaacactacggactatggcgtgttctattttctctgtggtaagtttgcgatagcagacctttgtggtggagagttactgaccagtttcagataaaagcgagcccaagccgaacattccggagaagaaagagcgcgaagccaaccgtgtcccacgccctcgcaacagctggatcctgtatcgccaatatcactcggcagaattcacgaagtcttatcctggcataactgcatcagagctttgtatgtgcactctggacaccatgctgcttagttggcaaagtggctaaccccctttatgcgcagcgacccttatatccacgaaatggaaggccgaaccgccacatgagaagcgtttttggaatgatttggcggagcaagaaaagcgcaaccatagggagaaatatcccgactacaagtacagggtcagaaagccgcaggcgaagaagaagattggaggacaggttatgactggcactactccggggcaaatatgaagagcaatccgcacgtaccagttactcgaaagtcatggcgttgtagggctctaaggctgccaacgtccaataccaagtgctcagaaggcgcgtttcatattccttagatactacatgtaggtagttaaccaaagttggtgcgaacccccattgtgctgccttctgcaatttctgaagtaccgcttttgctcctattaccataggggccaccaacctcccatcggtctgatcaatgctgatatgtcgtatgcctgaagagttcgttcaatccgctctttctaggtagacagagatcatcacctttgggactgcgaggcagcatattgagaagagtccacagaagagcctaggacctcttcggcgatacatactcgccaccccagccggggcgattgtgtgtactaggtaggctcgtactataccagcaggagaggtgctgcttggcaatcgtgctcagctgttaggttgtacttgtatggtacttgtaaggtggtcatgcagttgctaaggtacctagggagggattcaacgagccctgcttccaatgtccatctggataggatggcggctggcggggccgaagctgggaactcgccaacagtcatatgtaatagctcaagttgatgataccgttttgccaggattaggatgcgagaagcagcatgaatgtcgctcatccgatgccgcatcaccgttgtgtcagaaacgaccaagctaagcaactaaggtaccttaccgtccactatctcaggtaaccaggtactaccagctaccctacctgccgtgcctacctgctttagtattaatctttccacctccctcctcaatcttcttttccctcctctcctcttttttttttcttcctcctcttcttctccataaccattcctaacaacatcgacattctctcctaatcaccagcctcgcaaatcctcaggttagtattactactactacaatcatcaccacgatgctccgcccgacgatgcggcttctgttcgcctgcccctcctctcactcgtgcccttgacgagctaccccgccagactctcctgcgtcaccaatttttttccctatttacccctcctccctctctccctctcgtttcttcctaacaaacaaccaccaccaaaatctctttggaagctcacgactcacgcaagctcaattcgcagatacaaatctagaatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataatgcatgtgctgtgttcctcagaatgggccccagaagggcgtcgagcattgtctatgaatgcaaacaaaaatagtaaataaatagtaattctggccatgacgaatagagccaatctgctccacttgactatccttgtgactgtatcgtatgtcgaacccttgactgcccattcaaacaattgtaaaggaatatgagctacaagttatgtctcacgtttgcgtgcgagcccgtttgtacgttattttgagaaagcgttgccatcacatgctcacagtcacttggcttacgatcatgtttgcgatctttcggtaagaatacacagagtaacgattatacatccatcgctttctatgattaggtactcagacaacacatgggaaacaagataaccatcgcatgcaaggtcgattccaacctagggtccgtgaaagccttgaaagcagcaaacacgacaggtcgaagtcacattgagaagataaatgccgcgttcattgcgactttctcgggttcgattaagatacaaagctggttcaaatgcaacaagcgctatgttacgaatgtgatccgttccaatcgctactccaaatgaaagtaccgcaccgccactcagagcctcgttctttctcaccggagggacctagcggccgggcgcagatatagaacgaccttcctgttagcaagtgtcagccaccagctggtctgcgcatgtggtaattgtacatgctcgagtatcgtactcgcagttcaccggcgagaagaggtagtgtgtagtgaagggcgtgcctccatcattggtactagcagccaacaccttctactaaaaagaagaggggtgtgggcaggagacaggcctaacgagtacgagtaaagggagtcaaagcagaaagcataaaaataactcgggaattgctgcagccagctttggagcagccgattgaacgagcagaaacagacaaaaaacagaacaagggaatagcaaggggaggaaagacctcaacataccacaattgactccgggcctcttcgtgacgaggctgatgcagggttcattgtgctcgcatcggggaagcttccgttttccgagcagttttgaccaggattcttttgctagaattgggtcaaataccctgtcaacttccatcggaagggtggaggctcccacggctgggttcagtccatctgggggggtcctcgggccaatcatcgccgcttctctctagcggcaatttgccagtcgcagaggttggcccggcctggtgtgacgacaggcgatcagagggcagcgctgctgccgccgctgttgtttgctcgcaagaaaacggggcgctggtgttggcgctggcagtcgtggtggcgtcgccgtctcttcccttcgtcacccgcttagcggatgagggctgaaaaaagccctgcagagtcgtctgtcctcttgtgccagcgcgagagcttctggcattcttcctttccgtagcgctcagactagcgctgctgctgctactcctgctgagagtggtggcacgaatggtgggagtggtgctcgtaatagcagcaccgccgtcgatcgccttgtttcgcttcggagatggtggacgagcacgatcgacacaccccgcagcacgttttgtggacgatggggtcgatggcgcctgtgaccccaactgagctagtagcggatttgttcttgcggagtcctgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 8 - DNA, 1467 bp, Trichoderma reesei QM6a
  CDS (1)..(164)
  CDS (233)..(507)
  CDS (587)..(1273)
  CDS (1322)..(1464)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR51617.1 (55213)
  ref <309>: DATABASE ENTRY DATE: 2006-10-18
atgacgtctcgcgcaaatctcattgcgcgcaccgtcatcagccagttcgataagctcccgtcgaaaagaaagccctgtgttcgcgacaatggcctcaacgaatgggtgcccctgagcggcatcgttgccgaaagcaatggggttttgacctgcctagcactagcgtgagcttgatctgaagtttccacaatcatttgaagttgcccaacccgttctaacatgacaagtataggacgggcatgaaatgcctcccggcgtcaaagctcaccgaggccaagggcgtggccatccatgactggcatgctgagattctcgctattcgaacattcaaccggttcctgctggatgagtgtcagactctcgttgaaagtctgaacaatgagcatgagagcatcctccagagacatgattctaaggatgatgtcgatccaacaagcagacgatgcacgagacccttcaaagtaaaggaggatgtgaagcttcacatgtattgctccgaagctccgtgtaagtttttcaaattatcctggatgcggtcttctgaatgccttgatgaaaggatcgtatagctcattatcaacgttaggtggagatgccagcatggaactcatcatggccgctcaagcagacgcctcaccatggcagctcccaactcctccaaagccagtatcagccagcacgtctacaagcctggaagcagactctacagctcagcttcccggacgagcgtacttctcccagctgggcatcgttcgccgcaaacccgcccgcggcgacgctccgcccaccctgtccaaatcctgctcagacaagatcgccctgaggcagtgcacatcgcttctctcatcactagcctcgctctttgtcgacccagcaaacgcctacatcgacacccttgttctcccagagtcgcagtactccgccgctgcgtgtgagcgggccttttcgcccacgggcagaatgaaggccgtggctgacaggcagtggcccggcgggtacgctttcaggccgttcaaggtcgaggccacggacgtcgagtttgccttttccaagagggcggttcaggctcactccgaggccatctcggcgagcaatcttgcggcaacgtggtcggcctctggctttgaggagtcgattctggggggcgtgcttcaggggaggaagcagtttgccgtgaggggcgcaagcaagtcctccagacgacagatgtggatgaagtcgaagcagctctctgagggcctctcggctgccgctcctactcctgggtcggacagtaatgctgaaaacgtccccgatacggatcgtcatcgagcactccaagagtatctctcatcagcaagtagctaccaggacatcaaagatgggcgtttgttgactgataggaggcacgtcaaggctcaagctcgagagcttgcgctcaagggctggatccagaacgaaggagacgccgactttggcatagcatag

SEQ ID NO: 9 - protein, 423 aa, Trichoderma reesei QM6a
MTSRANLIARTVISQFDKLPSKRKPCVRDNGLNEWVPLSGIVAESNGVLTCLALATGMKCLPASKLTEAKGVAIHDWHAEILAIRTFNRFLLDECQTLVESLNNEHESILQRHDSKDDVDPTSRRCTRPFKVKEDVKLHMYCSEAPCGDASMELIMAAQADASPWQLPTPPKPVSASTSTSLEADSTAQLPGRAYFSQLGIVRRKPARGDAPPTLSKSCSDKIALRQCTSLLSSLASLFVDPANAYIDTLVLPESQYSAAACERAFSPTGRMKAVADRQWPGGYAFRPFKVEATDVEFAFSKRAVQAHSEAISASNLAATWSASGFEESILGGVLQGRKQFAVRGASKSSRRQMWMKSKQLSEGLSAAAPTPGSDKYLSSASSYQDIKDGRLLTDRRHVKAQARELALKGWIQNEGDADFGIA

SEQ ID NO: 10 - DNA, 3554 bp, Trichoderma reesei QM6a
  CDS (1)..(2572)
  CDS (2641)..(3551)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR51873.1 (103470)
  ref <309>: DATABASE ENTRY DATE: 2006-10-18
atgtctcgtcagccgggccccgagaggtggctcgcgagtcgggtccaacccgactccgagtaccctgctcgaatcaccacaaggctctcgtcactggacttgggctccttggttgccccgacttccatcaacgtcaggaagtcgattccctctcccggcggcagcacgatcagcatggaagttgatgtgcttgcaaagcgcctcatcatcctgttcccgcttcgcgttaagaagaatgcgaacaccaccaccgagatccgccacttcaagatcttggctgagctggcgcaagccaagaccatctacagaaccgcccagcaagatggctgcgaggtcttcatcttccccttcgccatcccgccacaatactattggtgtgacgacgaagctcagcggaatctccccaacacgcgcgcacctggctggcgtgccatcgacatgtggcgaagggccacagacatctctgaggacactgccctttctttcacttttcccgtggctacagacagcacccatttggatcctgctttcctcgaggttggccgctggaccgccttgcgcgtcgtcctaagcaaagcagaccacgcctccaagctggctgctagccatcttctactcgcctttgaagatcgcaatatcaatctccaagtccgtgacgacttttgcgtcagccattctgcggtgacgatgtgggactttcttgaccaccagcaccatgtgagcagcgatggggatgccctagctctcctccagccgtccaagtttccatttgttcacctggagtttggagtccgatatcagcttgaggtctgcgttagccgtcgattgctcaacgaacacacggtatcgttggagtttttacaagggctggctgctctcgatcccctcgacgccaaacgcaggcttgagtttcttgcagaccagggagatgtcatgtacgaccccaaggatctcctcaactgggccgctgcctcaacctatatgcccaataccaggatcccccactattgcgtgttggcacgcaaagccgccgtcactcctactaccatcctcctcagcactcccgttgtcgaaacctcaaatagagtcctgcggtatttcaaccacattcaggaccgtttcctgagggttcagtttgtcgaagaaaccgaatttggccggatggccatgagctgccgcaacaaagaggacgtctggaagaaaattcttcggaccttgtaccagggcatccagattggtgatcgccattaccagttcctggcctttggcagctctcaactcagacagtgcggagcctacttcttttgcccaacagatcacatctcttgtgacgacatccgtcggtggatgggcgaggtcggccatatcagaatcgttgccaagtacgctgccaggctgggccagtgtttttctactacaagagagatgcgcggccttcccattcccgacgtgcgatccattcccgacgttgagaggaatggctactgctttactgacggagtcggcatcatatccgacttcatggcccagatgattatggaagagttgactctggatgtctatgccgagccttctgcatttcagttccgcatgggtggatgcaagggtgtattggtagtttggccccaggctacaaagggggaggtgtgtattcgacagtctcaggagaagttcaaggccgaagtcaagaatcttgaaatcatcaagtgcgccaaatattcatccgccactctcaatcgccagacaatcaccattctggaatgccttggtgtgaccaaaaaggccttcttggacatcttggaggaacaaattcgtctctacgaagaagcaatggggaagaacgatgtggcgattgagatgttgaccaattgcgtcgacgagaatcaatctacgctgatcctcgctgaacttctgcaagccggcttcaaaacggacaaagttcaagaaccctttgtggcaaatctcctgagtctttggaggtcttggtccttgaagctgctcaaagagaaggctcgcattcccgtcgacaagagcgcctttgtcctcggctgcgtggacgagacaagtacattgagaggccacttcatcgcgacggaaggctcttcggacaaggacatcagcaagctgccccaaatcttcttgcaggtgtcggactccaagatttacaacaagacacatgtcgtcaaggggctctgcgtggttgggcgtaacccgtcgctgcatccaggcgacatccgggtcgttgaggctgtcgatatccccggccttcaccatctcaaggacgtcgtcgtctttccttccacaggagaccgccctgttcccaacatgctgtctggcggagacctcgacggcgatgacttctttgtcatctgggaacccactctactgcctgaaatctggaatcacccggccatgaactataccagtccctcgccagagacgcttgaccgcgaggtgaatgttgacgatctgcgtgacttctttgtcaaatacatgaaaaacgacgtgctccccctgattgcaacggctcacttggcacttgcagatcgtcttgggcccttgtcaaaaatctgtaagtcccccccaggcgtgcttgcttaccactctctgatatcatttactgacgtgctgaaaccccaggtttgcatctggctgatcttcactcgcaagctgtcgactacccaaagaccggccagcctgcggagtggaatgccgccatgcacaacccgcagcagtggccgcactttatggagaagaagaactcttacatttcgcccaaggcccttggagacatctataacagggtcaagcagcagtcgattcaattccaaccagattgggagactgcttttgatcgacgcatcctcgaccgcttcgagccggacaacgcaacgctccgggacgccagaagaatcaagtctcagtacgatggtgccgtacgtcgcatcctcgtgcaccacaacttggagacggaattcgaactgtatacctcctgggccatgtcaaagcccccgctcggcagcgagtacaaacggcaggaagacctcggcaaagagtttgacgcggtcaagcagagattccgtgatgcgtgcatcgaagctgctggtggccatgacgaggccaagattgacagattcgtggcagccatgtacaaaattacggagcaggaggtcaagattgctctctttgagcatcaccgcggaccaacgaacgaggctggtgtgatgaaaccagcccgagagctgcaggccagatcgatgccgctcatcagcttcccctggatcttcccctgggtcatgattcgaattgcaactgatggaaagtgcaagcccaaggactctatcctcgccgcggctcatcgaagagtgcctgtctctatgccctcttttgtccctctcacccagcaggaagatgaccaaggaatccgggatgtcaagcccaaggagagcgcagcgaagaatgacgaggagactgagattcaggactctgaggagggaactgcatcacagcaaccgggcctcttggtggaactcggtgacttggttctattctaa

SEQ ID NO: 11 - protein, 1161 aa, Trichoderma reesei QM6a
MSRQPGPERWLASRVQPDSEYPARITTRLSSLDLGSLVAPTSINVRKSIPSPGGSTISMEVDVLAKRLIILFPLRVKKNANTTTEIRHFKILAELAQAKTIYRTAQQDGCEVFIFPFAIPPQYYWCDDEAQRNLPNTRAPGWRAIDMWRRATDISEDTALSFTFPVATDSTHLDPAFLEVGRWTALRVVLSKADHASKLAASHLLLAFEDRNINLQVRDDFCVSHSAVTMWDFLDHQHHVSSDGDALALLQPSKFPFVHLEFGVRYQLEVCVSRRLLNEHTVSLEFLQGLAALDPLDAKRRLEFLADQGDVMYDPKDLLNWAAASTYMPNTRIPHYCVLARKAAVTPTTILLSTPVVETSNRVLRYFNHIQDRFLRVQFVEETEFGRMAMSCRNKEDVWKKILRTLYQGIQIGDRHYQFLAFGSSQLRQCGAYFFCPTDHISCDDIRRWMGEVGHIRIVAKYAARLGQCFSTTREMRGLPIPDVRSIPDVERNGYCFTDGVGIISDFMAQMIMEELTLDVYAEPSAFQFRMGGCKGVLVVWPQATKGEVCIRQSQEKFKAEVKNLEIIKCAKYSSATLNRQTITILECLGVTKKAFLDILEEQIRLYEEAMGKNDVAIEMLTNCVDENQSTLILAELLQAGFKTDKVQEPFVANLLSLWRSWSLKLLKEKARIPVDKSAFVLGCVDETSTLRGHFIATEGSSDKDISKLPQIFLQVSDSKIYNKTHVVKGLCVVGRNPSLHPGDIRVVEAVDIPGLHHLKDVVVFPSTGDRPVPNMLSGGDLDGDDFFVIWEPTLLPEIWNHPAMNYTSPSPETLDREVNVDDLRDFFVKYMKNDVLPLIATAHLALADRLGPLSKICLHLADLHSQAVDYPKTGQPAEWNAAMHNPQQWPHFMEKKNSYISPKALGDIYNRVKQQSIQFQPDWETAFDRRILDRFEPDNATLRDARRIKSQYDGAVRRILVHHNLETEFELYTSWAMSKPPLGSEYKRQEDLGKEFDAVKQRFRDACIEAAGGHDEAKIDRFVAAMYKITEQEVKIALFEHHRGPTNEAGVMKPARELQARSMPLISFPWIFPWVMIRIATDGKCKPKDSILAAAHRRVPVSMPSFVPLTQQEDDQGIRDVKPKESAAKNDEETEIQDSEEGTASQQPGLLVELGDLVLF

SEQ ID NO: 12 - DNA, 648 bp, Trichoderma reesei QM6a
  CDS (1)..(645)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR51590.1 (21412)
  ref <309>: DATABASE ENTRY DATE: 2006-10-18
atgcgccagtccatcggtacttcgctgctttacctcatcgggggagcaaacctcgtccttgccgcgtgcgagaactacagcttcacgacatgcgatgatggcattgtccactggtacgatctgaaggacggccagatctgcgaccccaaggactgcggaggcggccgggctcctcccagaaccgacgtgccgggctgccccctgtattcgggcacgatcctcagcgagccgatctcgtacctctcgtgcttcactccgtcgaatgccgtgccagtgacgacttcgactcctgctggcagtgctggaacaactgccgatgttgtaatcacaagcgccatctcgacctctgacgctggaagaacgacccaggagccggcgagcgagaccagcactgtcgattcgtctgtcgcttccggtaagccgtcgaccttgatcacgactgctgcctcttcgcctgcttccgcttcgaccaagactcccattacgagcccggcaactctctccactaagagccaagctacccacgcagcttcaaacacaacgagcggcagtgcttcaacgacgtcgactacgaacgctggaaatgcggtgggtggctcattgttggccgtggctggagttgcccttggagcttttgctctgctgtag

SEQ ID NO: 13 - protein, 215 aa, Trichoderma reesei QM6a
MRQSIGTSLLYLIGGANLVLAACENYSFTTCDDGIVHWYDLKDGQICDPKDCGGGRAPPRTDVPGCPLYSGTILSEPISYLSCFTPSNAVPVTTSTPAGSAGTTADVVITSAISTSDAGRTTQEPASETSTVDSSVASGKPSTLITTAASSPASASTKTPITSPATLSTKSQATHAASNTTSGSASTTSTTNAGNAVGGSLLAVAGVALGAFALL

SEQ ID NO: 14 - DNA, 1180 bp, Trichoderma reesei QM6a
  CDS (1)..(545)
  CDS (697)..(1177)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR51588.1 (119991)
  ref <309>: DATABASE ENTRY DATE: 2006-10-18
atggcagacaccgaggccggcagcgcgcccgtcgccgtcttcaaaaagcgaggcgcaaagggcaaagccaacctgcgcaaacgaccagcgacgcctccccccgccgcgagcgacagcgacagcgacagcgacttttcctcgtcggaagacgaagccgggcacagagtcaagaggcgcaagaggacggccgtcgtcaccgccgccgcgaggggcgccgcgcccagcaaccgggacgacggcggcggcgcaacagccgccttcacggccaacagaagcgtcccgattgctgacagcaacgacgcgaccaagcacagcaactggtacgacgaggacgcaaaggacgcgctctcggcaaagaacctcctcggatcttcgagagcgtccaaggacgcgcagccagacggcacgtacaagggcctggcgaaccagacgtcctttatacaaaagaatccggatgcgccccggaagacagttgggcccgtcaaggcgcctaccaacatccgcaccgtcaccattacagattatgccccggacacgtgtaaagagtgagtttgcatcaatagccagaatccccccccccgataccgtacattgagcatatgctgactcgtcataatctttctagttatcgcataaccggctatataagtactccccttttccatgattattccagtcgcgtactgacatttctaggagcctttactgtggttttggcgacaattgcaagtatcttcacgcgagagaagacctcaaggcaggctggcagctggatcaagagtgggaaaaggtcaccaagggcaagaagaacctggggggaacggtagtggccagcgcgaaccggaacaaggccaaggtggacgagggcgacgacgacgacgacgaagaggcgatgctcgagaacattccgtttgcctgcatcatctgcagggaatcgtacaaggagccgattgtgacgaggtgcgggcactacttttgcctgccgtgcgctctgcagcggtacaagaaggatccgacgtgtgcggcgtgtggctcgggcacgaatggcgtgtttaattcggcgacgaggttgaagaagctgctggagaagaagagggagagggcggccaggaggagacaggaggcgatagagaggggcgaggaagtcagtgatgaagaggaggaggaggaggaggactga

SEQ ID NO: 15 - protein, 342 aa, Trichoderma reesei QM6a
MADTEAGSAPVAVFKKRGAKGKANLRKRPATPPPAASDSDSDSDFSSSEDEAGHRVKRRKRTAVVTAAARGAAPSNRDDGGGATAAFTANRSVPIADSNDATKHSNWYDEDAKDALSAKNLLGSSRASKDAQPDGTYKGLANQTSFIQKNPDAPRKTVGPVKAPTNIRTVTITDYAPDTCKESLYCGFGDNCKYLHAREDLKAGWQLDQEWEKVTKGKKNLGGTVVASANRNKAKVDEGDDDDDEEAMLENIPFACIICRESYKEPIVTRCGHYFCLPCALQRYKKDPTCAACGSGTNGVFNSATRLKKLLEKKRERAARRRQEAIERGEEVSDEEEEEEED

SEQ ID NO: 16 - DNA, 3868 bp, Trichoderma reesei QM6a
  CDS (1)..(40)
  CDS (140)..(1197)
  CDS (1282)..(3651)
  CDS (3689)..(3865)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR50721.1 (120806)
  ref <309>: DATABASE ENTRY DATE: 2006-10-18
atggacgccgaggggcagccgccgactcagccaacgcagggtaagtcctatgctgctgctgatgatgatgatggagagattgcagagacgattcacgattcacgatcaggtcgctgacatgtgcctttggtctcgccagcgacgcaaaccgtcctcgacccgcgccgcatcggcaagcagaactcgggcttctcggacgatgacgtctcggacatcatctgcgtgctgtacccgcactcgcaggcggcgcgcctcgaggtgcagcagctggccgccagcgggtcgccgtacatcatcggcaaggacgaggccgacggcgtcgaggtcgactacgacgccgaggacgacgccagccgcttcgacgagatgccccaggacctgggcagccacgccctcatcctgcggctgtcgagcccggtcaagaacccggccgccggctttcgctttgggcgcaacggcgcccgctgcgacgtcgtcttcgccaacgatccgctgcgcagggtcagcaacatccacttccgcatctacatcaacgagtacggcaccgtcatggtcgaggaccactccaccaacggcaccaccgtcgacaacaacctgctcatctcccgcccccgcgacccggccgtcgccaacgaccccgaccgcaagaccaagtggatgctgagctcggggtccatcgtcggcatctacctgcaggacatgaggcacctctccttccgcgtccgcatcccccgccgcgagaacgagttcgacctggcctaccagcgccgcgtcgacgcctactttgcccgccaggccctgcgaggagggcctgtcgagaccgtcaccacgggtccgggtggccatgtcgacctcttcggcggcacggcagcgcagaacgcacaggcggccttggctccggccccaaacgcacaggctgccgcgctccgcgtccccgaccgccagcctcccgagcagcggtctccctcgaagcgcaaggaggcccgggttgcccaacgccagtggaccggatctggcaagtataacaagattggcatgattggaaagggagcctttgccgtcgtctacaaggtcacgtccaagtacaacggcgtgccgtatgctgccaaggagctcgagaagcgccgcttcatcaagaacggcgtcctggaccaaaaggtggaaaatgagatgcgcatcatgcagaaagtggaccatgtaagtttgcgtgatgccttgccttgcctgtgtgactgcgtttttcttttctttagctaaccattttggactcccgcgttgaagcccaacattgtgcggtacatagaaaactttgactgggacgatcgacttctcatcatcatcatggaatatgtgccgggaggcgatctcggaaagcacatcgcagacgatatgcccttttccgagtcggactcgagggaaatggccaaacagctgctgagcgcactgtcctatctgcatgccaacaacatcacccatagagacgtcaagccagacaatatactcatcaattccctccagccgctggacgtcaagctcaccgactttggactgtccaagatggtagacaccgagcagacgttcctccggacgttttgcggcaccctcctttactgtgctcccgaagtgtacactgagtatgccgagtacgacgaaaatggcgtcaggagcaggggtaaaaaggctcgccgcgtgccgggccaaaggtacaaccacgccgtggacatctggtctctgggcggcgtgctcttttactcaatgacgggccagcctccctatccggtcaagagcggcatcagttactcggagctgctgcataagatcatgacgaccctgctagacattcgaccgctggagaggcgtgcgatttccgacgacggcatcgacttcatatgcagcatgcttcagaggaaaccggagaatcgtgggacgatagacgagctgtttcgccactcatggctgacccctttatacattcaagcctcgcctcaatcctttgacgtggtcagcgatgacgaaggcgtcatgtcagacccgccccctgaatatcgtgagcacgagtacgaggacccgtttgaatttgacagggtgagcgactccaacggagaagatgaagaagaggaagaggaggcaagacgagaagaagcagggcagggcaggaataagggaaaggaaccggaggatgacgacacggataatgacatgcccataacaacaaggctcgagtaccccatcgaggaagccatgcacatagggacgcagcggcctcgtctctttggcgaaataggggcctccgccgtcggcaattctggagccgtaccagaggaccaccttaacctgccagttacaaacgggatcgactcggacagtggtagtggtggtggtggtggtggtgctgaaggcgagcttgacgaggcttacgattccggagattcaggcgcaactctggtcaaacgaaacgaccgccgctttctgcggcatgggacgagcatgtccattggccgccatcagtcggccgaccagctgcagagcctcgtcgaagaagttgcttctcaaaagctcaacggcaacgaatcccctgtcaagctctctgatgcgtcaaaccccacaactccttccatggacttcaacaccagcaagcgtaagacgtcctcgtcgctcgaggctagcgacgaactggacctcgaaagcacgcccactgggaagccggtcatcaaacggctcaagtcggagagcttcagccaagacgtgagcgcccagttgctcgaggagtacaggctgctggccagcatgcctccgatcaaaaagtccaactctggccgtcagatcgaccagcaggtgacgaaaacgctcttttggcagcaggatcgcagcacgtggcaccttaactaccccgagatgacgcagctccagtacgatgcctttgtccaggctgcgcgcaacagaaaggaggagtttggcccaaacaacaagcctttgtgggacttggccatgcggtactttcctcccactccgcctacaacgggcagccagatttcacggactcaggatgaggacgtcctcatggacattccctctaccggtgagcacgccgccggctacgaggacccggatgctggccgtctggatactcagcgggtggttcctgtgcagacgaacagtggcagtcgagccatcggcatgatcacctcgcacgagaagtcctgcatcaagaagattgagatgcacattacggactcgctgatatcctttggccgcggtgtgggcaacacggtcgtgttccagccaaagaccaacacgagagtgccaaagcatgcctttaagatcctgctatggaaggacggctacgacccggccaaggacgcccacccatggaaagacgaccttgcggacgcagcagactcgtacttcttctggatctccaccaaggcgaccatcggcatctccgtcaacgggcagcgcatcgcatccagcaacccggcaaaggcctctgcgccctcaatcaactgggccaagatctacaacgaggacgtcctggacctgtggcactcggaggacggcagggagcagaccaagctcgtcttccagtgcttctggggcggctcgcgtcgcaagcgcgaggaggactcgcagcggcgcctcgagatggcgagcgtcgccgcggccaaggtgctcgacgtggccgtgccagcggaccgagcggcgcatccgcgaggccgccgccctcaagcaggacgaggagcgcggccgcgacggcgccgacaggaggcaggccgagaagctgcgcatcaagagagccctcgaggccgacgacagggagcgccagcagcgcatctacatcgagcgttacatgagccacgtctttgaatag

SEQ ID NO: 17 - protein, 1215 aa, Trichoderma reesei QM6a
MDAEGQPPTQPTQATQTVLDPRRIGKQNSGFSDDDVSDIICVLYPHSQAARLEVQQLAASGSPYIIGKDEADGVEVDYDAEDDASRFDEMPQDLGSHALILRLSSPVKNPAAGFRFGRNGARCDVVFANDPLRRVSNIHFRIYINEYGTVMVEDHSTNGTTVDNNLLISRPRDPAVANDPDRKTKWMLSSGSIVGIYLQDMRHLSFRVRIPRRENEFDLAYQRRVDAYFARQALRGGPVETVTTGPGGHVDLFGGTAAQNAQAALAPAPNAQAAALRVPDRQPPEQRSPSKRKEARVAQRQWTGSGKYNKIGMIGKGAFAVVYKVTSKYNGVPYAAKELEKRRFIKNGVLDQKVENEMRIMQKVDHPNIVRYIENFDWDDRLLIIIMEYVPGGDLGKHIADDMPFSESDSREMAKQLLSALSYLHANNITHRDVKPDNILINSLQPLDVKLTDFGLSKMVDTEQTFLRTFCGTLLYCAPEVYTEYAEYDENGVRSRGKKARRVPGQRYNHAVDIWSLGGVLFYSMTGQPPYPVKSGISYSELLHKIMTTLLDIRPLERRAISDDGIDFICSMLQRKPENRGTIDELFRHSWLTPLYIQASPQSFDVVSDDEGVMSDPPPEYREHEYEDPFEFDRVSDSNGEDEEEEEEARREEAGQGRNKGKEPEDDDTDNDMPITTRLEYPIEEAMHIGTQRPRLFGEIGASAVGNSGAVPEDHLNLPVTNGIDSDSGSGGGGGGAEGELDEAYDSGDSGATLVKRNDRRFLRHGTSMSIGRHQSADQLQSLVEEVASQKLNGNESPVKLSDASNPTTPSMDFNTSKRKTSSSLEASDELDLESTPTGKPVIKRLKSESFSQDVSAQLLEEYRLLASMPPIKKSNSGRQIDQQVTKTLFWQQDRSTWHLNYPEMTQLQYDAFVQAARNRKEEFGPNNKPLWDLAMRYFPPTPPTTGSQISRTQDEDVLMDIPSTGEHAAGYEDPDAGRLDTQRVVPVQTNSGSRAIGMITSHEKSCIKKIEMHITDSLISFGRGVGNTVVFQPKTNTRVPKHAFKILLWKDGYDPAKDAHPWKDDLADAADSYFFWISTKATIGISVNGQRIASSNPAKASAPSINWAKIYNEDVLDLWHSEDGREQTKLVFQCFWGGSRRKREEDSQRRLEMASRTERRIREAAALKQDEERGRDGADRRQAEKLRIKRALEADDRERQQRIYIERYMSHVFE

SEQ ID NO: 18 - DNA, 1305 bp, Trichoderma reesei QM6a
  CDS (1)..(389)
  CDS (461)..(542)
  CDS (646)..(1302)
  misc_feature (857)..(857): n is a, c, g, or t
  misc_feature (868)..(868): n is a, c, g, or t
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR50649.1 (104898)
  ref <309>: DATABASE ENTRY DATE: 2006-10-18
atgccgacgttaaggcgagcgacgagggccggaagcgcgcgggcacatgttgacgcgggcgcggatgaggtgaacggggtggctacgccggagaagttgagagacaacgtcaacaaggcggttgaaaaggtgacgcccaagcgccgcagtggcgacgatgctgctcttgttgccagctctcccagtggcggcgcaagaccggaccgggaagcagcttcgacggccaggatcccgacgctggtgcagttcccgctggtcgcggccatcagcttcgccacggcgagcctcggatacagcgtggtcgccgagctgacccagggggagctggcgggcgtgagccggagcccggggacgagggaggagattgcgatccttgccggctggaggatgtgagtgggcttttttttttttgcttgggctttgctttgtgacttttcaacttgcttacgagatggcgtagatttgagcttgcgctgagctggttcggcgggttggacgggctggatgttgccatgatggatttcctgtcccacgggccggcggtaagttgtcgtaacacccaactctctgctgctgttaccttgaccgtttgtggagacgtttgagacatgtggcggttgaagctgacttggccaactttcttagatgtacctcctgttcgccttttacaacctcagcgcgaaaacgacgattgcggcccttgccgttgacgtcgtctctgcgtcggtgcccttttcgctcctgcggcccctctcggccgttcacaagccgtcctcggcgctgcccaaccgcgagctcatcgggtggcctctgcagctgctcacggcggggctctcgacgagcatatactccgacgnccagggcgcgncgcagcgattcctgctgcccagcatctttgtcgtccacttcgagggcctccgcaatctcgagccggcgtactcggcgtcgtatctcgccgtgctgcctgtgacgctgctgtttggcatcgccgcgagcaccttcatcttcccgccgtttgccaccacgggcaagaccaaggaggacgagcgcgtcaccaactttgaccccgccgaggccagcctgggagagactgtgtggtggaacttttggggctataccaccaaggccaaggtggccattgggcgcacggcggtgactctgctcgtcacgggcgtcaacacgtacctggcctgcgccatgaccatcccgggagttgagccagagggtgctgccgcatatgcgggcgtgtgggtgtttgcggctctctgcacgggcctgggcttggggctcgtgggacgcgactga

SEQ ID NO: 19 - protein, 376 aa, Trichoderma reesei QM6a
  misc_feature (228)..(228): The 'Xaa' at location 228 stands for Asp, Gly, Ala, or Val.
  misc_feature (232)..(232): The 'Xaa' at location 232 stands for Thr, Ala, Pro, or Ser.
MPTLRRATRAGSARAHVDAGADEVNGVATPEKLRDNVNKAVEKVTPKRRSGDDAALVASSPSGGARPDREAASTARIPTLVQFPLVAAISFATASLGYSVVAELTQGELAGVSRSPGTREEIAILAGWRIFELALSWFGGLDGLDVAMMDFLSHGPAMYLLFAFYNLSAKTTIAALAVDVVSASVPFSLLRPLSAVHKPSSALPNRELIGWPLQLLTAGLSTSIYSDXQGAXQRFLLPSIFVVHFEGLRNLEPAYSASYLAVLPVTLLFGIAASTFIFPPFATTGKTKEDERVTNFDPAEASLGETVWWNFWGYTTKAKVAIGRTAVTLLVTGVNTYLACAMTIPGVEPEGAAAYAGVWVFAALCTGLGLGLVGRD

SEQ ID NO: 20 - DNA, 2173 bp, Trichoderma reesei QM6a
  CDS (1)..(1697)
  CDS (1768)..(2170)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: AAP57759.1 (46816)
  ref <309>: DATABASE ENTRY DATE: 2006-10-18
atgattctcggctgtgaaagcacaggtgtcatctctgccgtcaaacactttgtcgccaacgaccaggagcacgagcggcgagcggtcgactgtctcatcacccagcgggctctccgggaggtctatctgcgacccttccagatcgtagcccgagatgcaaggcccggcgcattgatgacatcctacaacaaggtcaatggcaagcacgtcgctgacagcgccgagttccttcagggcattctccggactgagtggaattgggatcctctcattgtcagcgactggtacggcacctacaccactattgatgccatcaaagccggccttgatctcgagatgccgggcgtttcacgatatcgcggcaaatacatcgagtctgctctgcaggcccgtttgctgaagcagtccactatcgatgagcgcgctcgccgcgtgctcaggttcgcccagaaggccagccatctcaaggtctccgaggtagagcaaggccgtgacttcccagaggatcgcgtcctcaaccgtcagatctgcggcagcagcattgtcctactgaagaatgagaactccatcttacctctccccaagtccgtcaagaaggtcgcccttgttggatcccacgtgcgtctaccggctatctcgggaggaggcagcgcctctcttgtcccttactatgccatatctctatacgatgccgtctctgaggtactagccggtgccacgatcacgcacgaggtcggtgcctatgcccaccaaatgctgcccgtcatcgacgcaatgatcagcaacgccgtaatccacttctacaacgaccccatcgatgtcaaagacagaaagctccttggcagtgagaacgtatcgtcgacatcgttccagctcatggattacaacaacatcccaacgctcaacaaggccatgttctggggtactctcgtgggcgagtttatccctaccgccacgggaatttgggaatttggcctcagtgtctttggcactgccgacctttatattgataatgagctcgtgattgaaaatacaacacatcagacgcgtggtaccgcctttttcggaaagggaacgacggaaaaagtcgctaccaggaggatggtggccggcagcacctacaagctgcgtctcgagtttgggtctgccaacacgaccaagatggagacgaccggtgttgtcaactttggcggcggtgccgtacacctgggtgcctgtctcaaggtcgacccacaggagatgattgcgcgggccgtcaaggccgcagccgatgccgactacaccatcatctgcacgggactcagcggcgagtgggagtctgagggttttgaccggcctcacatggacctgccccctggtgtggacaccatgatctcgcaagttcttgacgccgctcccaatgctgtagtcgtcaaccagtcaggcaccccagtgacaatgagctgggctcataaagcaaaggccattgtgcaggcttggtatggtggtaacgagacaggccacggaatctccgatgtgctctttggcaacgtcaacccgtcggggaaactctccctatcgtggccagtcgatgtgaagcacaacccagcatatctcaactacgccagcgttggtggacgggtcttgtatggcgaggatgtttacgttggctacaagttctacgacaaaacggagagggaggttctgtttccttttgggtaagtgttttgtttccctccttctatcagtctatggcttctgttcttgtgatctctgacagtcgcacaggcatggcctgtcttacgctaccttcaagctcccagattctaccgtgaggacggtccccgaaaccttccacccggaccagcccacagtagccattgtcaagatcaagaacacgagcagtgtcccgggcgcccaggtcctgcagctatacatttcggccccaaactcgcctacacatcgcccggtcaaggagctgcacggattcgaaaaggtgtatcttgaagctggcgaggagaaggaggtacaaatacccattgaccagtacgctactagcttctgggacgagattgagagcatgtggaagagcgagaggggcatttatgatgtgcttgtaggattctcgagtcaggaaatctcgggcaaggggaagctgattgtgcctgaaacgcgattctggatggggctgtag

SEQ ID NO: 21 - protein, 700 aa, Trichoderma reesei QM6a
MILGCESTGVISAVKHFVANDQEHERRAVDCLITQRALREVYLRPFQIVARDARPGALMTSYNKVNGKHVADSAEFLQGILRTEWNWDPLIVSDWYGTYTTIDAIKAGLDLEMPGVSRYRGKYIESALQARLLKQSTIDERARRVLRFAQKASHLKVSEVEQGRDFPEDRVLNRQICGSSIVLLKNENSILPLPKSVKKVALVGSHVRLPAISGGGSASLVPYYAISLYDAVSEVLAGATITHEVGAYAHQMLPVIDAMISNAVIHFYNDPIDVKDRKLLGSENVSSTSFQLMDYNNIPTLNKAMFWGTLVGEFIPTATGIWEFGLSVFGTADLYIDNELVIENTTHQTRGTAFFGKGTTEKVATRRMVAGSTYKLRLEFGSANTTKMETTGVVNFGGGAVHLGACLKVDPQEMIARAVKAAADADYTIICTGLSGEWESEGFDRPHMDLPPGVDTMISQVLDAAPNAVVVNQSGTPVTMSWAHKAKAIVQAWYGGNETGHGISDVLFGNVNPSGKLSLSWPVDVKHNPAYLNYASVGGRVLYGEDVYVGYKFYDKTEREVLFPFGHGLSYATFKLPDSTVRTVPETFHPDQPTVAIVKIKNTSSVPGAQVLQLYISAPNSPTHRPVKELHGFEKVYLEAGEEKEVQIPIDQYATSFWDEIESMWKSERGIYDVLVGFSSQEISGKGKLIVPETRFWMGL

SEQ ID NO: 22 - DNA, 963 bp, Trichoderma reesei QM6a
  CDS (1)..(960)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49880.1 (59771)
  ref <309>: DATABASE ENTRY DATE: 2006-10-18
atgcctccagcggtagtcaagaactctgcttacactcctcccacgaaaggcatcctctcttgcctgccatcctcatgggttccctatgctgagctcattcgcctggacaagccacatggcatatatatgactatatatccttacgccttgggcctactttatgccagccaacttacctcagagtcgttgcctccaaacgtggtcctgagtcgatttctcaacttggcgatatggaccttcttgatacgaagcgccggctgtgcttggaacgacaacgttgatcaagactttgacagacaaactgcccggtgccgcgacagaccgattgcacgaggcgcaatctcgactcttcaaggtcatgtcttcaccaccgctctattggctctcgggtttttgtcaattcaaaactttcctcttgaatccaagattgatggcgctgcaactgtcttattgacatgcatctacccctttgggaagagattcacgcatttcgctcaggttaccttgggcctaacgctgtccgttgctatcatattcgggccgcattctgtgggcgccaaccccttgtcacagggcaatttcttgccaacgacctgccttgtgtcgtccatcattttgctcgtcatcttctatgacgtagtctatgctcgtcaggatacggtcgatgatctcaagtccggagtcaaaggcatggccgtcctctttcgcaactggatcaccacgttgcttttgaccctcatcatagccatcctaactcttctatacatcactgcacggtctcttgacttgggttgggtcttctttggcttgtccgttgcagggccagccgtcagcctcctcacaacgattgccctcatcgccagcaaatcgagcagttcaagatatgcgggcaagttctatgtgctagccattgccagcctgctcagtggctttactatagagtatctcagaacgattatgtag

SEQ ID NO: 23 - protein, 320 aa, Trichoderma reesei QM6a
MPPAVVKNSAYTPPTKGILSCLPSSWVPYAELIRLDKPHGIYMTIYPYALGLLYASQLTSESLPPNVVLSRFLNLAIWTFLIRSAGCAWNDNVDQDFDRQTARCRDRPIARGAISTLQGHVFTTALLALGFLSIQNFPLESKIDGAATVLLTCIYPFGKRFTHFAQVTLGLTLSVAIIFGPHSVGANPLSQGNFLPTTCLVSSIILLVIFYDVVYARQDTVDDLKSGVKGMAVLFRNWITTLLLTLIIAILTLLYITARSLDLGWVFFGLSVAGPAVSLLTTIALIASKSSSSRYAGKFYVLAIASLLSGFTIEYLRTIM

SEQ ID NO: 24 - DNA, 11824 bp, Trichoderma reesei QM6a
  CDS (1)..(832)
  CDS (903)..(5098)
  CDS (5651)..(7408)
  CDS (7496)..(11821)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49882.1 (59315)
  ref <309>: DATABASE ENTRY DATE: 2006-10-18
atggcgcacaatcctgcggaaccaatcgctgtcataggtttgggctgccgattccccggcagctccaacaccccctccaagctatgggacttgatctgtgacaagagagatattctgagaaagatccccatagacagattcaatgcagacagctacttccatgaagatggggagagacaggggctgatgaacgtcaagcatgcctacaccctagatgaggatatcagagcgtttgacgcctcctttttcaagataaacgcccgggaggcggaggccatggatccgcagcagcgactgctcttagaaacagtgtacgaagcgctggaatccagcggattatccatgggtgatctgcagggctctgatacatgcgtctatgtcggcagcatgacgggcgactaccacgaaatgctgatgcgagacccgcaagacatgcccaaatacatggccacaggaacagcacgaagtatcctttccaacagaatatcatactgctttgactggcatggaccgtccatgaccattgacacagcctgttcgtccagtctggtggcagtccatgaggcagtccaggcactgagaatgggaacgtcaaaggtcgcctgtgctgcgggtgccaacctgattcttggcccagagatgatgatttcagagtcgaaactgcacatgctgtcgcccacaggcagaagccgaatgtgggatgccgcagctgatggctatgcacgaggcgagggctttggagttgtcattctcaagaccttggctgaggcagttgctgataaggacaacatccactgcatcatccgtgagaccggagtgaactctgatggacgtaagtttcaccgcgttcatacttgaagaccaatgattttactaagatgaactgactcacctcggctcaggaaccaacggtatcacgctcccaagctccgagtcgcagacgactctaattcggcaaacatatgctcgcgcgggactcgacttgactaaggaccgatgccaatactttgaagcccacgggaccggaacgcctgcgggagatccgattgaggctcgagccatccacgacgctttcttcccaaacaaagcaacagccagcagcgacaatgtcctgtatgttggctcagtgaagacggtcgtcggccacttggagggctgcgccggtattgcaggcctaatcaaggctagtgaggccgtcagaagaggcgtcatcccccccaacatgctgttcgagcagcttaaccctgccattgccccttactacaacaatcttcaggtgcctcggcagccaatcccttggccggcgctcaaggaaggggaaccgcgacgagcgagcgtcaactcgtttggcttcggagggaccaacgcgcatgccatcatcgagagctacgacgccgaaaatgtccggcctctggtctcgcagtcggagcccatcattcccatccccctcgtgctctcagcaagctcgaatagcacgctaaagcgcatggtggccaacacaaggggcttcctcgtctccgacacatcagctcctctgcaagacgtcctgtacacgctttccgagcgcagatcccaacacgccgtccgggcgaccttctcgggacatagcagagcaagaatcgccgagaagcttcagattgcgatagatgacgacagctggacaggcatcaacgtggaagccaaggcggcccagccgcgcatcctgggtgtcttcaccggccaaggcgcgcaatggccgacaatgggtagggagatactcaagtcatctcctgtggcgcttgaaatcctcaacaaactgcaagaatcactaaacagtctgcccgatcccccattgtggacgctcaaggatcaaattgttgctgaacagagcacctctcgcctgtctgaggccgccgtcgcccagccgctgtgcacggcgctacaagtcatgctcgtcgacctattgtcgctggctggtgtcaggttcgacgttgtgcttggtcactcttccggcgaaatcggcgcggcttacgctgctggcatgatttcttcagaagaagctattcgcattgcctattacagaggggtccatgcaaagcttgcacgaggcaacaacggcaagccaggagccatgatggctgttggcctctcgtacgacgaagcatctgagttttgcgagcaaaacttctgtggcagggttgatgtcgctgcaagcaacgccccagccagcgtcacgctctcgggagacaaagacgcaattcaggaggcgcaggccatcttccaggagcaggggacctttgcacgcctcttgcaggtcgacacggcgtaccactcctcccatatgctgccttgttcggagccgtacctggagtctctggcggcgtgcgacatccagccgaagcagcctcgcgagggctgcacctggttctcgagcgtatacggggatcggatggagggcgacatgattgatgctctgacgggagaatactggaaagacaacatgatcaaccccgtgctcttttcgatggcggtagaactcgctgcaaacggtgaacttccctgtgatgtcgtgctcgaggttgggcctcacccagccctcaaagcgccttttactcagacgtacaaacaaagtgcgggcttggagctgccgtaccagggagtattgagccgtgggaagcacgatgttgagtcaataagtgaggcgctcggatttttatggacgcaccttggaactccaggcgcgaacctgggctccttctcgaaagcgttcaaccccgacttctcgcctcgcctcaccgccctccccgcatatccttgggatcactcgcagtctttttggaaagaatctcgcaagtctcgcaattttcgcagcaagcccgattctcgccatgccctcctgggagaccgatcaacagaagatattgaccagagcatggtatggaggaacatactccgcctcgaagagctgccttggctcgatggccaccgagtcgagagccagatcatattcccagctgctggatatcttgtcatggcgcttgaatcatccagctccttgactcatgatgccgaccatgaagtcgagctgattgagctgtacgacgtcgagatcggaaacgccatcccgctgtcggatgaatcgccaggcgtagagactctcttcacgctgagaccagcgaagcccaacgggcgtaccatcacagctgagtgggcatgctactctcctgcgggcgttgacacatcatggcggtgcaatgcttcgggaagtcttcgcgtcatattttgcgatgcccacggtgacgatgagattcttcctcgccgtgttgcccctgtcgcgtccctaagcagagttgagacggagcgcttctacacttcgctgactgagattgggctgaactacacaggtccttttcgagccctgcgagcgatcgaacgcaagtccggcatgtcgacttccattgtgactcaacaatcggggctgcccgccatcattcaccctgcggttctcgatgcggcgttccagtccgtctttgcagcattctgctggcctggcgacgggactttgcgcggtccgtttgttcccacaaggttgcggaaactgcgcatcgtcagcaaacaccttctcgagtctgcgggggaacttgttgtcgactctttcatcactcaatcatcagcgcagaatttgacggcagaccttggcgtcttcgacatcgcttctaacaaaggcattgtgcagttggaaggcctgacttgcacctccctcaccccaccaggcccgcaagactacaaggagctgtacacgcggcctcagtgggaggttgatattgccagtgcggttgcctctcttcccactactgacggagatgatgccgacgatctggaacttgttgacctctgcgagaggctcgcgtactactacctccgccgactcaatgacgagattgatcgcagcgaggttcccgccatggagtggcactttcaacgcatcttcgaatggatcgattacctgtttccttggatcgaagagggcacacatcccacgattcgaaaggagtggaagtcggacacaggtccctggttgcatcagcaaagagccagattccccgaccaggtcgaccttcagcttatcacggccgtgggagagcacctcgccgaggttgtccgtggccagaccacgatgctggaacacatgatcaaggacgacgtcctgaacagattctacaagcttggactggggttccagagagcaaacggtttcatgggccgtatcgctaagcaggttgctcatcgatatcctcgtatgaagatcctcgaaatcggcgccggcaccggcggggctacgaagggaatactcgaagcgctgggcacggcattcgagagctacacgttcaccgatatatcaactggattcttcgaagccgctgcggaggcattctctccttggatcgacaagatgatcttcaagccactaaatgcggaaattgacgttcttgaacagggctatcaggagaaatcgttcgacttcatcattgcctcaaacgtgctgcacgcgaccaagtcattgtcggagaccatgagaaacatccgtcgactgctcaagcccggcggctatctcctcctccttgaggtcactagcgatattgttcgtgtgaagctgatgatggctggcttgtcaggttggtggctgggaggcgaagacggccgccgctacggaccaaccatcactagagagcagtgggattcattattgagaaacacgggattttccggtgtcgaccacattatcaacgacttcattgacgagtccaagtacatgacgtccgtcatggtctcgcaagctgttgatgaggacgttgctctcctgcgacagccgctgttggcctccgccgaacaccacgcctggacccgctctccaatcaccatggttggcggaagattggaagatgtcgcattccgaactgccaaggcattatcttctattccaggcctgaaacctcaaattcacttggtcgagaagcttgtggatatagcagaaacatccctgcccacgaccacgcttgtcgttctggaggacctggacgagcctgtattgcaaagagtctcacaggagaaactccgcgtcctccaggaggctcttccacaaagcagacagctgctgtgggtgtcacaaagagcgcgctctgagaatccgtacggcaacctctcaattggtctctgccgaggtctctctgccgagtaccctcacgtctcagtccagcacatagactttgacgacgacatcactgaggcttccatctcaatcatcgctgaagccatcatccgcctagtgtatgcggatcagcggaagttcaacggcggggttgtctggaccagcgagcccgagttgctcgtcaaggataacaagctgcttacgctgaggatcatgcccgacacgcttctcaacgaccgcctgaatgctcgtaagatggtcatcaaaagcgtggcatctgccaaaagtgataccattgatctttgtatcatgggcgatagctatgttctgacgacccgcgaggcgtctctgttccggccggtcgatgcgaatctcgtcaaggtcaaggtgtcgcactcgtccgtgtctgccattcgcctcaatgatgctaccgctgcttacctttccgccggctacctggagcacaatcccgccataagtgtcattgcgctatccagcacccatggttcaactatcagcgtggctcctggctgcgtcttcaaggtcgctcaaggctcaaacgctgtgaccattctgcaagacgtcacagctgctgtgattgctgaccagctcatctgtgacattccgtttgggagcactgtcgtgttgcacagaagcgacaagtttctcggagcagtgatcaaacgcaaagcagccaaggctggactgagtgtgaagaatatcggccttcacaaatatgtctccgagaaggtgttgcgcgacgccgttcctgcatcttcacgacttgttgtcgactttgctcccgtttccgattgggctgattgcctacccgaggattgcaaatactggaacgtgcgaaacctcttcccacaatcgcccaagggagagccagttcttgctgcagaagctgtgaagcggctcgttgatctggcacagctgcagccatctatcttctcaaaggttgatgtcgtccctctggctgatcttgttaagcaacccgtatcagcgacatcatactcaaccattgttgacttttccgatactttgcctattccagcccaaatgtccgtcctcgatgcctcaacgcttttccgaagtgaccatacgtatctgcttgcaggctgtaccggtggcctcggtaaagctctctgcctatggatggcatcgcagggcgccaaatactttgcactcacaacacgagatccccgcaagatcgaccagctatggctcacggaattggctgcattaggtgccaaggtcaatctctacgggctaagtatcgcggacaaggttgccctgtcggctgttcgtgaccagatcgagcaagatatgcccccaattgctggtgttgtgaatgcagccatggttctctccgatagatcgttcggtgaattgacagctcaagactttcagatggtttttggtcccaaggttgacggtaccaagatcctcgatgagctgttccacgaccagccgctagacttcttcatcatgttctcctcccttgcaagtatcgttggcaaccgtggtcagtccaactacgtcgccgcgaatctgttcatgtctaccattgcagagcaacgcaggcgaagagggctggcggcatccgtcatccacattggcatggtcttaggcgttggatatgtgtcgtcaactggcatctacgagagcattttgcgtcagtataactacatgccgattcctgagcaggacttcttggacatgttttctgaggccatcgttgttggccgacccgagtccagccattgcccagacctcatcaccggcttgaaccgccacagtctacgcgacgatgtgcagcggccattctggcacgagaatttgaagttctcccaccacacaatcagcgaataccgtcaggctgaggctacaacagcagaaaggatgtcgctggcgcagcgcctagctcaggcaatgaccacagaggaagcagagaacctcattcgagagggcttttgtgccaagcttgagcggatgctgcaggccgcgaaggggtccatccatgtatcgcagtccctactgaatctgggcgttgactctctgattgccgtcgagattcgctcctggttcttgaaggagctggatgtcgacgtgccagtcctcaaagtcctcagcggagcatcagtttcagatctatgcaaagaggctgccggaaaggtgacaattggtactgaaacacccagcgaagtagttgcaccagtggttgctgaacaggtatgttgcgacctagagcaatgatgaaggcctgctgctaacctccgccagaaaccggctcaagtcccccaggtcacggaacccattcaactgactcccacctcgacaatcacgacggctgctcaatccactacgccatctgtcttcgacggctcaagttcctcctccagtcgcggtgtttcgccccctcgatcatcatctgatgtcattgagaatgagcccaagataacgcggcagcagctgcacattgagcgggtggcggagatgtcatttgcgcagcgcagattgtggttcttgcgccaatttctccaagatccaacaacatacaacgtgacgctttcgtacagcatcactggccgactgcgaatcaatgacttccgcaatgctttccgacaagttattgcacgacacgaatcgctccgcacatgtctctacaacgatccagacacaaatacgcccacacaggccgttttctcggatgcgatctttgaactcgactgcaaagcgggcacaacagttgaacgcgagttttccaatatgcgcgaacacgtctttgacctcgaaaacggagaaaatatgagggcagtcgtcatctcaaaatcagagtctaagcacttcttcgtgctcggctttcaccatcttgcttttgatgggttcagtgctcagacattggtcaaggacctggcaatgttttatgccgggcggcctttgcctccccttcgataccagtatgtcgactttgccatcaaggaaaggactctttcgtggaatgatgatatcgcgtactggaaggctgagttctctgagcttcccgagactctgccgctgtttgaattcaccgagacaaaagctcgtattcccttgactgagtacagtacccgagctttgacgcagcaacttcctgatcgtatcgcgtcgcagatcaaagcggcatcgagagtcctggacgttactcctttccatttccacctggccataacgcaagcgatgttgtctcgtctgttgggcatcagcgacgtctgcattggaattacggatgccaacaagaacgattcggagtttctcgatacgattggcttctttgtcaatctgctgccgatccgcttcaagacagatggcactcagtcttttgctagcctagcgacaatgacaaaagacaaggtgcataaagcgctggcacattctcgggtaccgtttgataaactcctggatgagctcaagattcctcgttcaacataccatagcccgcttttccaagtggttctcaactacaagatgggttcaacccagtctgttcccctggcagagtgcgaagcgcgagccattcgattcgaagatgccagaaacgcctacgacctaagctttgagattgaaaacttaccagatggcggagtgcttctctctctcaagacacaagattacttgtataccgaccatgatctgcagacaattcttgttacatatacacatctgcttgacacattgtcacgcgaaccaagctcggccatcaacgcagtcgaccttgcccctgcttcacgtttggacctcggtttgcagcttgctcgaggcgatacatacgagccagcaattttccaccttcccggttggcttcatcattggaccacccaacaacctgatgcaattgccattaaagacgattctggtgctgcgttttcataccgcgagactacggagcgagtcaatgacattgcggggctgttggtcgacgctggcgcccagtcaggtcagcgagttggttcttactgcgagccaagcatcgatgccatttgcgctcttctggcgatacaaaagattggctgcgtctacgtgccgctcgatgtgcagaatccggtgcctcgcttaaatcttatcatcaaggattgtcagccatcgcttttggtgtatcacgacgcgactgaaccatctgtgaagcattttgagacgtctgcatcactggtctccatttctaagatttcttcatcaaagacaactgcttcgcagtcatccgcgctcgatcattctgccacagcttatatactctacaccagtggtacgaccggcattcccaagggagttatgctgtcgcatgccaacttgatgtaccacattgccggcgtctacaacaaatacggtctggagaaggaaacagttcttcatcagtcgtctctcgggttcgatttgtcgctggcccaaatctgtcaagctctgtactctggaggcagtctcgtcattgcgctgaaggagtgtcgacgggatccagcgcttctcgcgaagctcatgcttgacgaaaaaatcacctacacgtggatgacgccaactgagtattccatgattttgagatacggtgccgaatacctgcgacaatcgacatattggcgctcggctttctctgctggagagtttatgtcatctaatctgctcaacacattcctgggaatccatcctccacgcctccgcctcttcaacggctgcggtcctacggagatcacaatcaacaactgtattggtgagaacgagctgagcgactcggcgccgcgtgatactcgaaatccatccattggaaggtcgctaccaaattattctacatatgtactcgatgagaacctgaagccagttccggtcggatttccgggagagatctgtgtcagcggccctgccgtgtcccaagggttcgttgatcgcgatgagctcactgctgcaaagtttcagcccgatccttacggttctgggcacttgtatcgtactggcgacaaggccaaattccttcccgatggccgccttgtgttcctcggccgtatgatgggtgattctcaagtcaagctccgcggcttccgagtagagctcaacgacatcgccaacaccatcatcagggctagcgaaggtgtcattcgtgatgcggcagtcagcttccgaagaggacaggacacaaccgaggacttcttagcagcttttgttgttccatcttcaaatcaggatattgttgcgcccagagtcctggaacagcttcgagacaagttgcccctgccggcctatatgcgccctgctagactaatcgtcgtgcatgacttacccgtgaactcgtcgggaaagctcgatcgatacgccttggataagcttccaattcctggcatttcttcgactgctgaggttgaacagctaaacgtgacacaatcaaagttgagagagctttggcttaaagtcctgcctgatgtggatgctgctgcgatcggtaccgacacggacttcttctccattggcggcaactctctcctcatggtccgtcttcgtggattgatcgcgcaatacttctgcacagagatctctgtgtttgagctgtttcaatccagtagcttgggcagcatggctgccaagcttcggtcatctgagactcgggaggtgatcaactgggacgaggagacttctgtgcagcctttgtcggtcactgatagcactgcccttcagcaagcctcagacgggctcgaagtcctactcaccggagccagtgggttcctcgggtcatctatactcagtcgccttgttgcagacgaacgcgttgccatggtgcactgtgtcgcgctccgcgggattcgccctctggctgtgcagtcaccaaagattaaagagtatcccggagatctttcaaaggaccttctgggtctatccgaatccgaatttaggactctgtgcaatcgcgtgcaccgcatcattcacaacggcgcgacagtatctttcctacagtcttattcgtctcttcgcaagccaaaccttgagagcacaaagacgctggtgtccctcgccgcattcagaggcattccgctgcactatgtttcttccgccggagttgccaaatttaccgggttggacggcctacctcctgtttccatttcccagcacgaaccaccgactgatggatcagacggctattcggccacgaagtgggcgtgtgaagtatacttggaaaaagtgacggaaaacaccaacctgtctatctggatccatcgccccagcagtatcacgggagaaaatgctcctgataccgacttgatgcagagcatcattcggcactctctggccttgcgggccattcctgatctctcctcctggcaaggcagcttcgactttgtccccgttgacgacgttgcggcaggcatcacctcagccttatacgacgtcggtcagggtttaacgtttgctcatcattgcggcaagcaaaagatacccgtttatgagctaaagaagcatttggaaagtgcaaacggcatcaagctagatgttttgaacttgaaagaatgggtggacagggcaaagtccgacggattgctggacaatgccagcgaggctatgattgacggagtcgtgggcgtttctgatggcaaggcgattttaccgagcctactttag

SEQ ID NO: 25 - protein, 3704 aa, Trichoderma reesei QM6a
MAHNPAEPIAVIGLGCRFPGSSNTPSKLWDLICDKRDILRKIPIDRFNADSYFHEDGERQGLMNVKHAYTLDEDIRAFDASFFKINAREAEAMDPQQRLLLETVYEALESSGLSMGDLQGSDTCVYVGSMTGDYHEMLMRDPQDMPKYMATGTARSILSNRISYCFDWHGPSMTIDTACSSSLVAVHEAVQALRMGTSKVACAAGANLILGPEMMISESKLHMLSPTGRSRMWDAAADGYARGEGFGVVILKTLAEAVADKDNIHCIIRETGVNSDGRTNGITLPSSESQTTLIRQTYARAGLDLTKDRCQYFEAHGTGTPAGDPIEARAIHDAFFPNKATASSDNVLYVGSVKTVVGHLEGCAGIAGLIKASEAVRRGVIPPNMLFEQLNPAIAPYYNNLQVPRQPIPWPALKEGEPRRASVNSFGFGGTNAHAIIESYDAENVRPLVSQSEPIIPIPLVLSASSNSTLKRMVANTRGFLVSDTSAPLQDVLYTLSERRSQHAVRATFSGHSRARIAEKLQIAIDDDSWTGINVEAKAAQPRILGVFTGQGAQWPTMGREILKSSPVALEILNKLQESLNSLPDPPLWTLKDQIVAEQSTSRLSEAAVAQPLCTALQVMLVDLLSLAGVRFDVVLGHSSGEIGAAYAAGMISSEEAIRIAYYRGVHAKLARGNNGKPGAMMAVGLSYDEASEFCEQNFCGRVDVAASNAPASVTLSGDKDAIQEAQAIFQEQGTFARLLQVDTAYHSSHMLPCSEPYLESLAACDIQPKQPREGCTWFSSVYGDRMEGDMIDALTGEYWKDNMINPVLFSMAVELAANGELPCDVVLEVGPHPALKAPFTQTYKQSAGLELPYQGVLSRGKHDVESISEALGFLWTHLGTPGANLGSFSKAFNPDFSPRLTALPAYPWDHSQSFWKESRKSRNFRSKPDSRHALLGDRSTEDIDQSMVWRNILRLEELPWLDGHRVESQIIFPAAGYLVMALESSSSLTHDADHEVELIELYDVEIGNAIPLSDESPGVETLFTLRPAKPNGRTITAEWACYSPAGVDTSWRCNASGSLRVIFCDAHGDDEILPRRVAPVASLSRVETERFYTSLTEIGLNYTGPFRALRAIERKSGMSTSIVTQQSGLPAIIHPAVLDAAFQSVFAAFCWPGDGTLRGPFVPTRLRKLRIVSKHLLESAGELVVDSFITQSSAQNLTADLGVFDIASNKGIVQLEGLTCTSLTPPGPQDYKELYTRPQWEVDIASAVASLPTTDGDDADDLELVDLCERLAYYYLRRLNDEIDRSEVPAMEWHFQRIFEWIDYLFPWIEEGTHPTIRKEWKSDTGPWLHQQRARFPDQVDLQLITAVGEHLAEVVRGQTTMLEHMIKDDVLNRFYKLGLGFQRANGFMGRIAKQVAHRYPRMKILEIGAGTGGATKGILEALGTAFESYTFTDISTGFFEAAAEAFSPWIDKMIFKPLNAEIDVLEQGYQEKSFDFIIASNVLHATKSLSETMRNIRRLLKPGGYLLLLEVTSDIVRVKLMMAGLSGWWLGGEDGRRYGPTITREQWDSLLRNTGFSGVDHIINDFIDESKYMTSVMVSQAVDEDVALLRQPLLASAEHHAWTRSPITMVGGRLEDVAFRTAKALSSIPGLKPQIHLVEKLVDIAETSLPTTTLVVLEDLDEPVLQRVSQEKLRHNPAISVIALSSTHGSTISVAPGCVFKVAQGSNAVTILQDVTAAVIADQLICDIPFGSTVVLHRSDKFLGAVIKRKAAKAGLSVKNIGLHKYVSEKVLRDAVPASSRLVVDFAPVSDWADCLPEDCKYWNVRNLFPQSPKGEPVLAAEAVKRLVDLAQLQPSIFSKVDVVPLADLVKQPVSATSYSTIVDFSDTLPIPAQMSVLDASTLFRSDHTYLLAGCTGGLGKALCLWMASQGAKYFALTTRDPRKIDQLWLTELAALGAKVNLYGLSIADKVALSAVRDQIEQDMPPIAGVVNAAMVLSDRSFGELTAQDFQMVFGPKVDGTKILDELFHDQPLDFFIMFSSLASIVGNRGQSNYVAANLFMSTIAEQRRRRGLAASVIHIGMVLGVGYVSSTGIYESILRQYNYMPIPEQDFLDMFSEAIVVGRPESSHCPDLITGLNRHSLRDDVQRPFWHENLKFSHHTISEYRQAEATTAERMSLAQRLAQAMTTEEAENLIREGFCAKLERMLQAAKGSIHVSQSLLNLGVDSLIAVEIRSWFLKELDVDVPVLKVLSGASVSDLCKEAAGKVTIGTETPSEVVAPVTEPIQLTPTSTITTAAQSTTPSVFDGSSSSSSRGVSPPRSSSDVIENEPKITRQQLHIERVAEMSFAQRRLWFLRQFLQDPTTYNVTLSYSITGRLRINDFRNAFRQVIARHESLRTCLYNDPDTNTPTQAVFSDAIFELDCKAGTTVEREFSNMREHVFDLENGENMRAVVISKSESKHFFVLGFHHLAFDGFSAQTLVKDLAMFYAGRPLPPLRYQYVDFAIKERTLSWNDDIAYWKAEFSELPETLPLFEFTETKARIPLTEYSTRALTQQLPDRIASQIKAASRVLDVTPFHFHLAITQAMLSRLLGISDVCIGITDANKNDSEFLDTIGFFVNLLPIRFKTDGTQSFASLATMTKDKVHKALAHSRVPFDKLLDELKIPRSTYHSPLFQVVLNYKMGSTQSVPLAECEARAIRFEDARNAYDLSFEIENLPDGGVLLSLKTQDYLYTDHDLQTILVTYTHLLDTLSREPSSAINAVDLAPASRLDLGLQLARGDTYEPAIFHLPGWLHHWTTQQPDAIAIKDDSGAAFSYRETTERVNDIAGLLVDAGAQSGQRVGSYCEPSIDAICALLAIQKIGCVYVPLDVQNPVPRLNLIIKDCQPSLLVYHDATEPSVKHFETSASLVSISKISSSKTTASQSSALDHSATAYILYTSGTTGIPKGVMLSHANLMYHIAGVYNKYGLEKETVLHQSSLGFDLSLAQICQALYSGGSLVIALKECRRDPALLAKLMLDEKITYTWMTPTEYSMILRYGAEYLRQSTYWRSAFSAGEFMSSNLLNTFLGIHPPRLRLFNGCGPTEITINNCIGENELSDSAPRDTRNPSIGRSLPNYSTYVLDENLKPVPVGFPGEICVSGPAVSQGFVDRDELTAAKFQPDPYGSGHLYRTGDKAKFLPDGRLVFLGRMMGDSQVKLRGFRVELNDIANTIIRASEGVIRDAAVSFRRGQDTTEDFLAAFVVPSSNQDIVAPRVLEQLRDKLPLPAYMRPARLIVVHDLPVNSSGKLDRYALDKLPIPGISSTAEVEQLNVTQSKLRELWLKVLPDVDAAAIGTDTDFFSIGGNSLLMVRLRGLIAQYFCTEISVFELFQSSSLGSMAAKLRSSETREVINWDEETSVQPLSVTDSTALQQASDGLEVLLTGASGFLGSSILSRLVADERVAMVHCVALRGIRPLAVQSPKIKEYPGDLSKDLLGLSESEFRTLCNRVHRIIHNGATVSFLQSYSSLRKPNLESTKTLVSLAAFRGIPLHYVSSAGVAKFTGLDGLPPVSISQHEPPTDGSDGYSATKWACEVYLEKVTENTNLSIWIHRPSSITGENAPDTDLMQSIIRHSLALRAIPDLSSWQGSFDFVPVDDVAAGITSALYDVGQGLTFAHHCGKQKIPVYELKKHLESANGIKLDVLNLKEWVDRAKSDGLLDNASEAMIDGVVGVSDGKAILPSLL

SEQ ID NO: 26 - DNA, 2450 bp, Trichoderma reesei QM6a
  CDS (1)..(1262)
  CDS (1443)..(1447)
  CDS (1834)..(2447)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49694.1 (36822)
  ref <309>: DATABASE ENTRY DATE: 2006-10-18
atgttccagtttttcaaatcagaattcttcaatttcgagttcttgcgtgtcctacacgccgccccttttcacggatcggaaattggagagtgccttgttgccaggaccaggattactgataatgatccggaaagctggtaccgcgcctggacagcagaagctgagcgtgcagtcagcgtgggcgaagacgctgtaaagcatggcgatcgggtcgaagcttcatgggcattcatcagagcttcgaactattatcgttccagcgagttctttctgcactgcgagccgcaagatccccggcttctgaacgctgcccaaaaaagctttgatatttttgaacggggggtcagactgttggatggcgagctccacactcttgagatcccattcgaaggcaacatatcgatgcctgcgaggctcttcctcccgcctgctcataagatggtgacggataaattgcccattctggtccaaatgggaggctttgattcgacgcaggaagagctgtacttttacgggccagcaggcggacttcctcgtggatatgctgttctaacatttgatggccccggtcaaggcatctctctgcggcgagacaggactcacatggtgtctgactgggagagagtgacatctaaagtgttggactttctcgaaagcaaactggcagcaaaccacaacattgacatggatcgagtggccgtgctaggtgcatctcttggagggtatctagtgctgcgagctgccgccgatccgcgagtccgagcagccatctcgacagacggatgctatgacctctttgacgtgaccaagagtcgaatgcccaattggttcatcggcggctggctgaatgggtggctaagtgacagcttctttaactttgttgtcaaccgactggcggcagccaatttccagcttcgctgggaatttggccacagcatgtggatatatggcgtgaacaacccagccgacgttatgaggcaaatgcagcgcttcacgctccgccttgaagacggaggagagtatctatccaagttgaagtgcgccactatgataacaggcgcttcggacacgttctattttgtcccagaaatcaatgccgagcgaatcttccggaagctagaccacattgacaacagcaagaaagagctgtggatcggtaagggggtgagtgaaggcggcctccaagcaaagattggggctctagcgctttctcatcagaggatgtttgcctttttggatatgcaatttggaattactcgaccgtctctgtcctaggagcggatatactttgtatgcgataccctacaaaaccttacctacctactctacctcatataaaactatcttatcctgttgattcaatggtggaggacacaatctcagctctgcaagcgatgatagacgcgtgtagacgcgtgagcttccggaccatgcaacttcagggcgtgtcctatggcagaccatgggctgctactttgacggggccaacaatagttttctcccagtttccgtagagagtaaaccctccgaatcctccgcccagggccttacaaaagatccagaccacccgaaagagaagaaccttgagtcaaaaaattaacctcagtctttctgctggctttcaagattaccagctactggctactgcgtcgaatcgatcagccagcgaaaagagccccgcaacaatgacgaccgtcggcacattgtattcttacgtacctaatgcaagatgtctcaaggtgggtgattcgaatgcttgcgagtataagggagtactcttagtcagaactccaacgccaatatcctttagcttggacttggattgacgatgagaccagatcctcgctgcggccaaggtcaacgggatcaatgttgcaacagcgtcagattacaagcatatggtcaccaataagacacccgagttcctggccaagtttcccatcggcaaggttcccgccttcgaagccaccgacggcaccacaattgccgaatctgatgcaatcgcacaatacgtctcggaggtaggccctcgctcagtccagctgctgggagccaatgcccccgagagggccagggtccgacaatggatcagtttcacggacaatgaggtatacgggaacatgatgggcgtcgtgctctctcgggcaggattcgcgccctatgtgccagagaaggaggctgccgccgccaaagggctgagctttgggctgggagttgtcgagaaatggctttcgggccgggaatggctcgcaacggaccagcttagcttagcagatctgacattggctgccgccttgtattgggcgtacatgcactatctcgatgacaagaggagggaggcttatccactcgtgacgtcgtggtacctgcgaaccatcggcgccgaaggagtcaaggacgtgtttgggcaccctaatctggtagctaccgcgaaggaattcgaggcatga

SEQ ID NO: 27 - protein, 627 aa, Trichoderma reesei QM6a
MFQFFKSEFFNFEFLRVLHAAPFHGSEIGECLVARTRITDNDPESWYRAWTAEAERAVSVGEDAVKHGDRVEASWAFIRASNYYRSSEFFLHCEPQDPRLLNAAQKSFDIFERGVRLLDGELHTLEIPFEGNISMPARLFLPPAHKMVTDKLPILVQMGGFDSTQEELYFYGPAGGLPRGYAVLTFDGPGQGISLRRDRTHMVSDWERVTSKVLDFLESKLAANHNIDMDRVAVLGASLGGYLVLRAAADPRVRAAISTDGCYDLFDVTKSRMPNWFIGGWLNGWLSDSFFNFVVNRLAAANFQLRWEFGHSMWIYGVNNPADVMRQMQRFTLRLEDGGEYLSKLKCATMITGASDTFYFVPEINAERIFRKLDHIDNSKKELWIGKGVSEGGLQAKIGALALSHQRMFAFLDMQFGITRPAYQILAAAKVNGINVATASDYKHMVTNKTPEFLAKFPIGKVPAFEATDGTTIAESDAIAQYVSEVGPRSVQLLGANAPERARVRQWISFTDNEVYGNMMGVVLSRAGFAPYVPEKEAAAAKGLSFGLGVVEKWLSGREWLATDQLSLADLTLAAALYWAYMHYLDDKRREAYPLVTSWYLRTIGAEGVKDVFGHPNLVATAKEFEA

SEQ ID NO: 28 - DNA, 1826 bp, Trichoderma reesei QM6a
  CDS (1)..(291)
  CDS (456)..(552)
  CDS (675)..(732)
  CDS (797)..(1012)
  CDS (1096)..(1484)
  CDS (1543)..(1823)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49696.1 (3262)
  ref <309>: DATABASE ENTRY DATE: 2006-10-18
atgcatctcatcgactttaccaagtttgcaaacatcgtagacggcacccgtcgctcgtctgagagtttctacactggcacaaacgcggcgactggatcatcgctatggcagacccctgttgctacaagccaagacgtcgaagatgcggttgtcgctgcgcgaaaggcatttggttcctgggcagcgaaaacgtacaaggaccggactgagctgcttgaaaggtttgccgatatatttttggcccatgcaaaccagtttatcgagctgctaggtgcagaaacgggtcgaagtgtatgggataagtaactctgcttgaccaaaacatggcttatatcgtgtctaggctcaagtgaatgcgattgaggtacactgggcggcgaactggtttagatacccatgttggtgaattggtgctgttggcggctgggctgggctgaccggaacgaatagcaaagtatgaaatatcagagaaaaggcaagaggatgagacgaaatatacgattgtccgatacgagcctctgggggtcgtggcagcgatatgtccatggaattgtgagtctggttgcttcaagtactacagttggatgctggctaaacatctaccctcagttcccttgatgctcggtatgcccatttcagttgcagctcatcgtgaatctgtctgatgaatgcagcaattggcaaaattgccccagcgatagccacaggaaactgtgtcatcgtgaagccatcgtatgctctcccagtgccggaaaagtacctaacaatgatgcagcttctgattaattataagtaggccatttgccccatacacggcgttaaaactggttgagttggctcaacaggtatttcctccaggagtagtacaagctttgggaggagatgatcatctaggtccccagctcgtccgtcatccaggaattcaaaagatatcattcactgggtcaaccattgctggcaagaagattatggaggcctgtgccgggacggtcaagaggctgactttggaaatgtaggacaactcatctgatgccccccccccccccccccccctcctttttgagtcttgcagcgaaagctgataaagagaaatagggccggaaataatccatcgcttgttcttccagacgttgacatcgagaaaacagctcctttgatagctgctggcctatggttcaacgcaggtcaaatctgtctcgctagccgccgattatacatccacgaaaccatctatgagagctttgttgacgcacttgcacgagccacaaactccgctgccaaagatgtcgtggccaacgtgggccctgtgcagaactatatgcaactgaagaaattgcaggcgttgtttgaagatattcgcaagcggggatacaaaatcagaaccgaacaggccgggatacgcgatggggaggggttttacgcctttcctacgattgtggataatccgccccctgattcgaccattgtcaaggaggaacactttggtaagcctgctgctagagtaccactgagaaatgattgctgataatgactgcatgccaggccccgtcatcccatgtataccgttttctgacgttgatgaagcaattcgtcttgccaataacacggaaagtgggctcgcggcgagcatctggacgaaccaaatggaacttgccgaagacattgccaggaggctagaggcgggaaatatctttattaatgggccacctcaaccagatccgtttgtcccctttgggggccacaagcagagcggtatcggggttgagtatgggcttgaaggcttgttgagctactgccagatcaagtcgatatacaagtatcaatga

SEQ ID NO: 29 - protein, 444 aa, Trichoderma reesei QM6a
MHLIDFTKFANIVDGTRRSSESFYTGTNAATGSSLWQTPVATSQDVEDAVVAARKAFGSWAAKTYKDRTELLERFADIFLAHANQFIELLGAETGRSYEISEKRQEDETKYTIVRYEPLGVVAAICPWNSIGKIAPAIATGNCVIVKPSPFAPYTALKLVELAQQVFPPGVVQALGGDDHLGPQLVRHPGIQKISFTGSTIAGKKIMEACAGTVKRLTLEMAGNNPSLVLPDVDIEKTAPLIAAGLWFNAGQICLASRRLYIHETIYESFVDALARATNSAAKDVVANVGPVQNYMQLKKLQALFEDIRKRGYKIRTEQAGIRDGEGFYAFPTIVDNPPPDSTIVKEEHFGPVIPCIPFSDVDEAIRLANNTESGLAASIWTNQMELAEDIARRLEAGNIFINGPPQPDPFVPFGGHKQSGIGVEYGLEGLLSYCQIKSIYKYQ

SEQ ID NO: 30 - DNA, 6770 bp, Trichoderma reesei QM6a
  CDS (1)..(600)
  CDS (660)..(5490)
  CDS (5554)..(5919)
  CDS (5979)..(6061)
  CDS (6118)..(6512)
  CDS (6695)..(6767)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49884.1 (105804)
  ref <309>: DATABASE ENTRY DATE: 2006-10-18
atggccaatgtatcaggaatcgtcttttctccccagagccgtgcgccgtcaaaggcgtatctggagtatatccacaactcacttaccagatcgtccatatactcgcccatttgcgaagcaatctccaacctttccgcgacgtggtgggctattgcaaacagccagccaaagatcgcctccctggagcaaggcctgaattttgcaaaagacttttcagcatggattgagacgggaaattcttcaaggctggagaccagcatgtcggggatcgtcacgttacctctgctggtcatcatacatacgattcagtatctcgagtatctacggcaaaactgtatcacacactcggaactgctacctcatttgcgggcaggtggggtccaaggattctgtgctggattgatgatggccattgttgtggctgcgtcaaaggacgaaacacaactggttgagaactccgccaaagctgttcggatagcctttgcgattgggtcatatggagagattgggtgtgatgcaaactcaattatttctactactatggtggtgcggttgaaacggggctctgagagggagcaaatcatccgcgagttcccagaggtgtgataatctactcagctccatctcaggagcacgcatgctaaagaagaatataacagtcccgtatctctgctgtatccgaccccaagacagtaagcatcattgcttcatcatcccaaattgccgccatgcaggcatatatagaggaactaggcctctccttcaagatggttcacatgcgaagcaacatacacaatccgaaaaatgtcgctcttgcgaaagagctgctgggactctgcctacgcgatgccgactggcagttgcccaacagcgattgtattcaggttgctgtacgatccaatagcacaggtcagattctttcaggctgttcgctcacagccgaggttatcaacaccattcttacctcttgctgtgactgggacagagtcatgaacaatgtagcgcaagatctccgccgattcgggaaatctcatcgcatagcaatggttggcctgggagactgcttaccgctcccgccatttcagaagattggcatcgaaattaccaaggtggatgtcatgagcaacacggaggatgcaaggcgacggacaaatgatgctaatatctcaagacgggctacttttccttccgattcggtcgccgtagtaggcgcggcttgtcgattaccaggagcaaataccctcgacgaactctgggatctcatttctcgaggcgaatcgcggctggaaacgctgcgccaagatcgggtcaggctcgaagagtcttttcgggcatcacaggacaaggactggaccacaagacgacaatggttcggaaatttcgttgattgtgtcgatgaatttgatcatggcttctttggcataagtgaaaaggaagcggcatatatggatccccagcagcggcttttgctcacttgtgcgtacgaggctctggactccagtggctaccttcatcatcatgcccgagcaaatggcgatccgatagggtgcttcattggcgcgagctataccgagtataacgagaacaccaacgcatacgctccctctgcatttgccgcaacagggaccattcgagcttttctttcaggcaagatcagccattactttggctggacggggccgtccgaggtcattgacacggcatgctcggcgtcgctggttgctgttcatcacgcaattagggcgattcagtctggggattgctccatggcccttgcaggcggtgtgaatatccttaccggagttcacaactacattgatctcggcagagcgggatttctcagtagaacgggccagtgtaaaccatttgatgaatcagcggatggctattgccgtgcagacggagtcgggatcgttgtgttgaagccactcaagcaagcaattgctgacgggaatcacattatgggcgtcatttctgcgacagctacaaaccagggcggcttgtctcagggtatcacagttccgcatggagatgctcagagggcgctctattgtcgaatcctcaagactgccaatattgagccagatcaggtgacatatgtcgagtcacacggaacaggtactcaggtcggcgatcctatcgaagtctccagcattcgcgaggtctttggagggccatcgcggcaatcagtggtgtacattgcgtccctcaaagccaatgtaggacacagtgaaactgctgctggagttgctagccttctgaaggtcctcacaatgtttgctcacaaagccattcctccgcaagctggattcaagacactgaatcccaagattcccgctgttgagccggataacatgatgattgccgctcagctcatgccgtgggattcgaagatacgcatggcctgtgtcaacagttatggggcctcagggagcaatgcggcgctgatctgtgcagaatggaccgctgagatagcaagaccgagagcgggtgcgccgacttacccagtctttctgagtgcgcatacaaaagatgctctgagagactcagccatccgactggcctcttactttcagagtcccggaaaagccttgagtattggcagcgtagcctttacattgagcgaacgcagaaaacaccaccgttatcgatggtccacctctgcacatagtctgtccgacctgaccagacaactgcacgcgggtgtgatggaaggcattgttgagtctcccaacacacgaatgccggttgttctggccttttcaggtcaatctaggacgaagatcggcctcgacccgacactctgcgaattatatccccagttccgccgttatctagagaactgcaatgacatactgcgaagcttgggctattcagacatcatgtcttcacttattcagaccgacgccgtcacagacgttgtcattctccatgcgggcacattcgctgttcaatatgcctgtgcgagaagttggctagaaggcggattgcaggttgacgcagtgatcggtcacagtctcggcgaattgacggcgttggctgtatccggcgtgctgtcactggaggatgctctgggtctggtcgcgaagcgagctctattgatagagagaaaatggggctcagaaccgggatccatgttggcgatttactcagatctcgagactgtgcagcagatcgttgcaagctcacacacgacagtcgtggaggatggccttgagatcgcctgccacaacagccctaacgctcatgttgttgttggaaagcgagcgtctattgcgagagttaaaaagcttatagacagcaatccgcagtttcaaggcacgcgacatcagcgtctcgatgtgagccacggctttcactcgagattgacagacccgttgctcccagatctaatcaagttcgccaatagcttgacgttcaatgagcctcttattccgctagagacatgtacggagtcgcctgttcttagcatcacaccgaagtacattgcagagcattcgagacacgcagtgtattttacacatgccattcggcgtcttgagcgccgtcttggcccatgcacctggttggaggcaggatggcatactccgatcatccccatggcaaagaaagctgtcgcaatgcctgagatacacaactttcaatcattgagtggctcggcagtggccgtctccaatgtaacggctgctctatggaaacaaggccattcaatttcctggtggggttttctctccccaggagactcacaactcgaccaaatctggctgccgccattttcgttccaaccatcccaccattggctcgaacatgttgatcgagtgacgaaagtccagcatcctgacagcaaggtgcttcagcagcgatctcgacttgtgagcttcgtcaaagtatcggccacaggcgacgagttccagctcctcaggcagtgtgaaaaatacagcaacatagtcaaaggccacgctgtgcgccaaaggcctctttgtccagcttccttgtacatggaaattgccgtcatgtgtgctcaggagagaggttttgactttaacgagcacacgatcaaattccgcgagattgtcttctccaacggcctgggatgcgacaacagccgtgatgtgagagtcgtgttggcacaaaatctagactcaactgctgatggtgcatggaatttctcagtcaacagctcaaaaaaaggtgatgcgaagtctgtaaggacgatgcatgcgattggacagtttgctgctttatcagaggcgtccgactttcgtatatacgaggggctcatctcggaccgcatggctctcctccccaaggatccaaacgcagaacacctaaagagaagaacggcgtatgctgtgttctcgagagttgttgagtatgctgaacttctcagaggtatctcctcgatcactttgtctgaagatcaagctatcgctgagatcgagctcccagctgaagcgtcgacgaactgcgatagcactgtcgaccgctttatggacgcgatatctctggatacattcatacaggttctcggcctgttgatcaactcaagactcaacactgtaggccacgagatctttgttgcgacaagcatcgagaacatgacaattctcccttgcgacttcaagacccagaaacgctggagtgtgtacgccatgttcggtatgaagggtgatcgacaagccattggagacgtctttgtattctctcccgaaggcaggctcgtcattcttgggtcgcagataagtttcaccaggatcaaggcaagcatactagaagaattgcttgacagaaactactcagaatccgtcatggtcaaagctcagcgagccgagggcccagctgcgtctggtgtgatgcatcgcattcgcactggtgaggctatcgctgcaggcagttctgtccttcctgttgattcgctgccggcgaagtctgaagaaccagcttacaacttcgacgacgcgaaggtgcttatagcaagttatattggtcttacggcgtctgagattcgcaaagaggaaagtttcagtagtctaggcctagactcactgtcttcagtcgaacttgccgatgagttgcgagttaagttcggaattgaagtttcgccaagtgacttgctcacaatgcaagtgggcgagcttgaacaagggggtccatcacaaggcacagactcaattgatgtacaggaacaggacctaccgcagtccataaacagacgtgtgaatggacttgcgaatggacgtgtcgctcaagccagtgggctgagaaacggccttcatgatggatgcagcaataacaatgtgagcggtcaagtgaaagaccacgcctatagctatgccagcaagacaaacggacatctagagaagcctctgagacgaccgcactacgcaaggcaccgcgttcagacggtaacttacaaagaagtcgacggcatccacattctggcagacatgttcattccgctagagccaccctcggaggctatgcccataggtacgcggtagctggccaactcatccctgaaataagtcaactgacatgttccattatcgatagcgctcatgatccacggaggcggccatttgacgctgtcgaggaaagccattcggccgtcccagacatcctttctcctagcaaatggcttattgcccattagcctagactatcgactttgccctcacgtcaatgtccttgatggacctatggcagatgttcgagatgcctatgcctgggcaagaaaagaggttccattgctgctgcgagaggcaggcatgtgcgtggatggctcaaagattgtcgtcgtcggctggtcaacaggagggcatttggcaatgactactgcttggactgctccagccgcaggtttgcctcctcctttggctgttttggcattttactgccctacacattacgatccttcgggtatgtttagacatttccattggaaagactttcgcaactttgctaacaattaataaaagatgattccttaagaatgggcaaagactaccattcccgcacaatgtcaatgtccgagatccgaaaggctttaggcacgcaaacagtatgttcattcttttcgtcgctccacatatcatcattactcatgcagacgtacaggcatcgagtcacgcattcagtagtactgatacaaccggtctgggctggcttgaaccaggagatccccgctcagagctggtgctggctcttgtcaaagaacagaacggtgtgtctcttttactagatggtgttcctactgatggaaacaccttccaagctcctgagcccgagcgagttacagctatcagcccgctgtctcaggtccgcctcggcacctatcgcacaccgacgtttgtcatcatcggcgacgaggatgaagttgtccccttccactcttcggttgactttgttgatgccctgagaacacagggtatcagacacgggttcatcccggtaccgggtcagcgacacattttcgacctgacgcttgcaccggggatggcgaaatgggaagagtgggtggctccaggctacaaattcttgtttgacatccttggtatttcttccgattgataccctcttccctcgaggagagtatggtgttgggcctggctgtggggttggcacaggcggctagaagtctcgcgtcaagtttgggctcttcttaaaaatgggcaattacgcattcattgaacagatatcacaagtacacggctctccccgtggagcaccaaaatggcattccacaaagtatgcgggacatcgacacgtag

SEQ ID NO: 31 - protein, 2116 aa, Trichoderma reesei QM6a
MANVSGIVFSPQSRAPSKAYLEYIHNSLTRSSIYSPICEAISNLSATWWAIANSQPKIASLEQGLNFAKDFSAWIETGNSSRLETSMSGIVTLPLLVIIHTIQYLEYLRQNCITHSELLPHLRAGGVQGFCAGLMMAIVVAASKDETQLVENSAKAVRIAFAIGSYGEIGCDANSIISTTMVVRLKRGSEREQIIREFPESRISAVSDPKTVSIIASSSQIAAMQAYIEELGLSFKMVHMRSNIHNPKNVALAKELLGLCLRDADWQLPNSDCIQVAVRSNSTGQILSGCSLTAEVINTILTSCCDWDRVMNNVAQDLRRFGKSHRIAMVGLGDCLPLPPFQKIGIEITKVDVMSNTEDARRRTNDANISRRATFPSDSVAVVGAACRLPGANTLDELWDLISRGESRLETLRQDRVRLEESFRASQDKDWTTRRQWFGNFVDCVDEFDHGFFGISEKEAAYMDPQQRLLLTCAYEALDSSGYLHHHARANGDPIGCFIGASYTEYNENTNAYAPSAFAATGTIRAFLSGKISHYFGWTGPSEVIDTACSASLVAVHHAIRAIQSGDCSMALAGGVNILTGVHNYIDLGRAGFLSRTGQCKPFDESADGYCRADGVGIVVLKPLKQAIADGNHIMGVISATATNQGGLSQGITVPHGDAQRALYCRILKTANIEPDQVTYVESHGTGTQVGDPIEVSSIREVFGGPSRQSVVYIASLKANVGHSETAAGVASLLKVLTMFAHKAIPPQAGFKTLNPKIPAVEPDNMMIAAQLMPWDSKIRMACVNSYGASGSNAALICAEWTAEIARPRAGAPTYPVFLSAHTKDALRDSAIRLASYFQSPGKALSIGSVAFTLSERRKHHRYRWSTSAHSLSDLTRQLHAGVMEGIVESPNTRMPVVLAFSGQSRTKIGLDPTLCELYPQFRRYLENCNDILRSLGYSDIMSSLIQTDAVTDVVILHAGTFAVQYACARSWLEGGLQVDAVIGHSLGELTALAVSGVLSLEDALGLVAKRALLIERKWGSEPGSMLAIYSDLETVQQIVASSHTTVVEDGLEIACHNSPNAHVVVGKRASIARVKKLIDSNPQFQGTRHQRLDVSHGFHSRLTDPLLPDLIKFANSLTFNEPLIPLETCTESPVLSITPKYIAEHSRHAVYFTHAIRRLERRLGPCTWLEAGWHTPIIPMAKKAVAMPEIHNFQSLSGSAVAVSNVTAALWKQGHSISWWGFLSPGDSQLDQIWLPPFSFQPSHHWLEHVDRVTKVQHPDSKVLQQRSRLVSFVKVSATGDEFQLLRQCEKYSNIVKGHAVRQRPLCPASLYMEIAVMCAQERGFDFNEHTIKFREIVFSNGLGCDNSRDVRVVLAQNLDSTADGAWNFSVNSSKKGDAKSVRTMHAIGQFAALSEASDFRIYEGLISDRMALLPKDPNAEHLKRRTAYAVFSRVVEYAELLRGISSITLSEDQAIAEIELPAEASTNCDSTVDRFMDAISLDTFIQVLGLLINSRLNTVGHEIFVATSIENMTILPCDFKTQKRWSVYAMFGMKGDRQAIGDVFVFSPEGRLVILGSQISFTRIKASILEELLDRNYSESVMVKAQRAEGPAASGVMHRIRTGEAIAAGSSVLPVDSLPAKSEEPAYNFDDAKVLIASYIGLTASEIRKEESFSSLGLDSLSSVELADELRVKFGIEVSPSDLLTMQVGELEQGGPSQGTDSIDVQEQDLPQSINRRVNGLANGRVAQASGLRNGLHDGCSNNNVSGQVKDHAYSYASKTNGHLEKPLRRPHYARHRVQTVTYKEVDGIHILADMFIPLEPPSEAMPIALMIHGGGHLTLSRKAIRPSQTSFLLANGLLPISLDYRLCPHVNVLDGPMADVRDAYAWARKEVPLLLREAGMCVDGSKIVVVGWSTGGHLAMTTAWTAPAAGLPPPLAVLAFYCPTHYDPSDDSLRMGKDYHSRTMSMSEIRKALGTQTASSHAFSSTDTTGLGWLEPGDPRSELVLALVKEQNGVSLLLDGVPTDGNTFQAPEPERVTAISPLSQVRLGTYRTPTFVIIGDEDEVVPFHSSVDFVDALRTQGIRHGFIPVPGQRHIFDLTLAPGMAKWEEYHKYTALPVEHQNGIPQSMRDIDT

SEQ ID NO: 32 - DNA, 588 bp, Trichoderma reesei QM6a
  CDS (1)..(168)
  CDS (231)..(345)
  CDS (407)..(585)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49704.1 (59402)
  ref <309>: DATABASE ENTRY DATE: 2006-10-18
atgtcgggcacaatgcctggcacagactcgacaacaattccttggcacgctgcttacccagctccagacactgtggcaaagtcaatttggcgagatgaggttctggacatgatgaaacacgggacgaggaaatatttactggtagaccttcgcaggaatgatcatgaggtaggtatgatagtggattgggccaaggaggcaatggtagatctctgatgttccccttgcagggcggcctcattcgaggatccatcaacttgccagcacagagcctatatcccagcattcctaccatttttcggttgatcaaagccgctgggatagtcaaagtcatttggttttgcggtaagatgttcttcaccgcaatgaaagctcaacggcacttaccaatgtgcgtttgacccagcttcttctcgaggccgcggcccccgagccgctgcctggttcaacgattacctcgccaaatgcggcgagacggatgtggaaagtttggtgctgttgggaggcattaaaggctgggcaacggcgggcgacgaatacgtcagttggatggatgagtacgaggcatcagtctggacaagagaatag

SEQ ID NO: 33 - protein, 154 aa, Trichoderma reesei QM6a
MSGTMPGTDSTTIPWHAAYPAPDTVAKSIWRDEVLDMMKHGTRKYLLVDLRRNDHEGGLIRGSINLPAQSLYPSIPTIFRLIKAAGIVKVIWFCASSRGRGPRAAAWFNDYLAKCGETDVESLVLLGGIKGWATAGDEYVSWMDEYEASVWTRE

SEQ ID NO: 34 - DNA, 1503 bp, Trichoderma reesei QM6a
  CDS (1)..(1500)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49889.1 (105816)
  ref <309>: DATABASE ENTRY DATE: 2006-10-18
atgtatcaacgaatcttcggcgtgactctctccctcttggcctttacaccgaccgccaattcccagagcaacaagccgctgaaatggaaggaatgcgatcccccgagcccatacccaaacgtccaatgtgccaaacatccggtgccttacgactggggctcgggactcagtcagtacacggcaatgagcgtgatgcgcgtcaagtcgcgcaccgaaaagcccaaaggcacaatcttcctcccctccgggccaaaacgctccggcaccaggcttctcaagcagtaccttggagagaactcgtcggccgcgatggaactgctcgacgagtatcacatcatgggcctggacgttcgtggcatatcggaccaatcacccatcaagtgtaacgcaactcgatggaacagacgcgtgcctagcatgcccaagaatttgacacagtataacaggatgcagcaacactggaggaaaattgcagaggagtgcagggagatgacgggggagctgctgtttgaccacatggacacatccacaatcggacaggatatcgagaacgtccggtacaataattgggagcttccgcccaagaatcgcaagatgcacatgatcggcctttcgtggggcgcgcaaatcgggctcgcctacgtcgaaaagatctccgcgtatatgggcaacattgtgctggacggcatcactgatcacacacagggcccgatcggcaccatcatggccgagtccgcggcctttgagacgacgctgaagcacttcttcgactggtgcagggctgaatcttcttgcgcactacacagtcagccaaatctcgagcacttcttcactgaacttgcttccaaagccgagaacaaacccattaccgcacccaattgtaagcaggacgcaggcgaacattcctgtcgacccaacgtcaatctggaggagatgatgttgaacgtgcagaaatacctggcttctgggccacccggatggtcgtttctagcagagagcctgttggatgcttccgaaggagacgcttccgccctttctgcccattggttcacgtgcgagaccgatccaacctccacttgggcctccctccttactggttgtcaagattggatacctgcccgcgattttctagagctcttaggaacccagcgaacactacgaatcctctctcctctgacacgcggatatacgcaaagcttcctgtactactctagatgcatttcctggcctcggaagcagaaaagagtgcagaacggacagcgcccattgttgcaagaagggaagtcaatcaagccccttttgctcgtcacctccgccttggaccccatatccagcgcccagggggccatatcgctacgcgctcagattccacaagctgttctggtgtacacaaacaagacgggacatgagagttatggcgcgcgaggagatcttacctatatagtcaacagcgttttcagaacagactcgtttccacaagacggatctgtatatcagacatga

SEQ ID NO: 35 - protein, 500 aa, Trichoderma reesei QM6a
MYQRIFGVTLSLLAFTPTANSQSNKPLKWKECDPPSPYPNVQCAKHPVPYDWGSGLSQYTAMSVMRVKSRTEKPKGTIFLPSGPKRSGTRLLKQYLGENSSAAMELLDEYHIMGLDVRGISDQSPIKCNATRWNRRVPSMPKNLTQYNRMQQHWRKIAEECREMTGELLFDHMDTSTIGQDIENVRYNNWELPPKNRKMHMIGLSWGAQIGLAYVEKISAYMGNIVLDGITDHTQGPIGTIMAESAAFETTLKHFFDWCRAESSCALHSQPNLEHFFTELASKAENKPITAPNCKQDAGEHSCRPNVNLEEMMLNVQKYLASGPPGWSFLAESLLDASEGDASALSAHWFTCETDPTSTWASLLTGCQDWIPARDFLELLGTQRTLRILSPLTRGYTQSFLYYSRCISWPRKQKRVQNGQRPLLQEGKSIKPLLLVTSALDPISSAQGAISLRAQIPQAVLVYTNKTGHESYGARGDLTYIVNSVFRTDSFPQDGSVYQT

SEQ ID NO: 36 - DNA, 2039 bp, Trichoderma reesei QM6a
  CDS (1)..(841)
  CDS (901)..(1085)
  CDS (1145)..(1158)
  CDS (1214)..(2036)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49895.1 (59391)
  ref <309>: DATABASE ENTRY DATE: 2006-10-18
atggcatcggctgttgccttctccctggcggtgtcggcgctgctgcagcccgtccttggcactaatacaggcacggttcactgtgccgatgcctcgtacgaaccgggctccgtttacttcacgaacaagtgttacaccgacatccagaactgcataaccaagctgtcggccgatccgtcactggttgactgcagtggcgacaacatcagcatgcagcagcaggccaatacgggagctgtcggctcagcccaaaacagcgatgtgagcgtctccttcaagagcatggtcgacctttgcctcctgagcggctcaaccagcggaacatggggttggagtgacaaccagtggtactggctgtggaccagcggcagctgctacaccggtgaggccggaaacggcgccatcaagacgcggcctgccccctattgtctgcaagaccgggactccaccctgcccgactgctatcctcagcccaagcccggcggtggcccgctaagggtgctcaagatggccaaaacgaccaatggcttcacgaagtcggcgcgaggctggaacacgtacggagcccaggctctgaccaacggctccacgctcattccctccttcgctggtcagtccggcctgtattatacgcaaaagttcgtggagactcaatgcggagtcttggcaaactccaagttcaaggctgctggttacgatatgtgcagtcttgactccggctggcagtcgtttgatacggtcgatgatcatggccgcatcatctacaactcgacgcgcttcaacatgccccagcttggtccctggctgcataagaagggtcttaagctcggcctatatatcagtgagtcttgccattcctatttgccccttcatccctctctcccattctgactcttgcagcaccgggagtcccatgccaagctgccaactcgacgattttgggcaccgacatcaaggttggagacacgttcaacggcaactttgaccagattctgtgccagtttgactacaacaaggaaggtgtccagcagtggcacgattctgttgtggctctgtgggcttcgtggggcgttgacatgatcaaggtcagttgagatgcaatcacggctatatgagggagcttcagctgacaagaataaaacagctggactatattacgtgagtcaatatgccttgtgctcaaggattgaataagactaacatcattcaacagccctggttccccacagaatggcgccatgctgggctgtcagaactccgacgccgttgtcgcctaccagaaggccattgccaagtcggggcgtgacatccgcctgaacatctcgtggaaactctgtcgcaacgagacctggctgcccgtgtggagccgcctggccgagtctatgcgtaccgaccaggacatcaacaactacgggcacgagacctttttggcctggcaggttgctcagcgcgccattgagaattaccggcaatacattagcctccagcttcagcgcaacgtgcccctgaccatctacccggacatggacaacctgtttgccgccaacgccgagaagctgacgggcgtcaacgacacgatgcgaaccactgtcatgaaccactggcttggtgctggcgccaacctgatcctgggcaacgacttgacccagacggacgcgctcggctacaagctgctgacgagcccccagtccacgactgccgccaacttctttgccaagtatcccatgcagccgcggaaccctcgaaccggcaacaatctggcccaacagctgcagtcgtggatcgccgggccgagtgacaatggaaaggaggcgtacgttctgattgccaactacggaccagaccagggctccggcggcttcaacacgcatctttacggacgacagactgttactgtgtccctggccactcttggtcttagctgctcagagtggaaatttaccgatgtgtggtcgggcaactctactcgcgtcaaaaactactatacggcctacttaacggagggagagtcccagctgcttcacttgaccaaggtctaa

SEQ ID NO: 37 - protein, 621 aa, Trichoderma reesei QM6a
MASAVAFSLAVSALLQPVLGTNTGTVHCADASYEPGSVYFTNKCYTDIQNCITKLSADPSLVDCSGDNISMQQQANTGAVGSAQNSDVSVSFKSMVDLCLLSGSTSGTWGWSDNQWYWLWTSGSCYTGEAGNGAIKTRPAPYCLQDRDSTLPDCYPQPKPGGGPLRVLKMAKTTNGFTKSARGWNTYGAQALTNGSTLIPSFAGQSGLYYTQKFVETQCGVLANSKFKAAGYDMCSLDSGWQSFDTVDDHGRIIYNSTRFNMPQLGPWLHKKGLKLGLYITPGVPCQAANSTILGTDIKVGDTFNGNFDQILCQFDYNKEGVQQWHDSVVALWASWGVDMIKLDYITPGSPQNGAMLGCQNSDAVVAYQKAIAKSGRDIRLNISWKLCRNETWLPVWSRLAESMRTDQDINNYGHETFLAWQVAQRAIENYRQYISLQLQRNVPLTIYPDMDNLFAANAEKLTGVNDTMRTTVMNHWLGAGANLILGNDLTQTDALGYKLLTSPQSTTAANFFAKYPMQPRNPRTGNNLAQQLQSWIAGPSDNGKEAYVLIANYGPDQGSGGFNTHLYGRQTVTVSLATLGLSCSEWKFTDVWSGNSTRVKNYYTAYLTEGESQLLHLTKV

SEQ ID NO: 38 - DNA, 2905 bp, Trichoderma reesei QM6a
  CDS (1)..(257)
  CDS (322)..(602)
  CDS (660)..(2902)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49708.1 (59689)
  ref <309>: DATABASE ENTRY DATE: 2006-10-18
atggggcggttcttagcagcgctctggcttgcggcgagctgcgtcaccgcgcagagtatattcaatctcagcgatgtttcgtggacggtcagcaacggcgtcaacgccaccgtgcccggcaagcttccctcgtatgcccacatagacctgctggctgctggcgtcattgacgatcccatatatggcttcaacgagtggaaccagttctgggtccagcgaatgaactggacatacacgtccgggccgatcaagggactgtaagtggttgtgtggcggctgggcggcagttttgagcctcaaagctaacaagaaacgcattagtaagtctggagaagagttgacttcatggctcgtattcgagggtctcgacaccttttgtgagatcaagctctgcggccagaaagtcggcgacaccaagaaccagttccgcaaatacacctttgatgtctctgacatcctgcccaagtgcaagggcgatcctgtcctcagcttgaatttcgggtccgcgagcaagattgtgctcgacatttcccagcggggcgatctgtgtacgttgatctccatgcctgtgtcgtgtgaaagtctctccgcttacatgttttgtcgatgttcagccactgtcaattctgccaatggctacggcggacaggagtttcaaggccgagtctatatgcgaaagcaggagagcgacttcggctgggactggggcccgcagtttgctccagctggtccatggcgcccggcgtacattgtgcaaaagggcaagacggatcccgtgtacatcacgaacacggccatcgacatctatcgccaaggtcaaatgcccaatctgtcgcccgatcagtccaagccttgggtcttcaatgctagtatcgattacatcggtaccttgcccaaaggctcacagttccacgtcaagatcgtcgacagcaagggccacacgctcaaggaggccaacctggtcggcatcacccagagtgacggtactatcaccggcagcaccgccatcaacaccaaggttgacctgtggtggccctccggctacggagagcagccattgtacaccgcgacgctgtctctcatcagtgcaggagtctccaagcatgccaccgtcaccaagcgcgtcggctttcgaaccattgtcctcaacctcaatgccatcactgaggcagacaaagccaagggcgtcgctccgggagccagctggaaattcgagatcaacggccacgagatgtatgccaagggctccaactttgtccctcccgacgtcttctggccccgtgtgaaccagaccaagatcaaggagacgttcgagctcgccatcaactcccattttaacatgatgcgaatctgggcctccggagcctatctgcctgactgggcgtatgacctggccgacgagatgggtttgctgctttggtccgaattccaattctccgtcgcctacttccctgccacgcccgacttcctggctgagtatgaagccgaggcctactacaacacccgccgtgtgaaccaccaccccagtttggctctgtgggctggaggcaacgagctcgagtacctcatctatggctggtggctcaatccccggaataacacccagctggaggactatgagaccatcttccaacagcaccttgccaagtgtgtgtacgccaacacccactccatcagctatatcccctcttccacctaccacggatacacttcgcttgacttcaactccgtcagtcctcagacctcgcgatatgactacatggagagccccgatgcaatctaccatgacaccgacttctataactatgacggtagcatcgcattccagtacagcggctacccagttggtcgtttcgccgacgagtttggcttcccctctatgccgtccgtctactcctggagggatgccattcctgaaagcgagttcaactttgactcgtcatatgtccgccaccacaaccgtcatctgagcggcggcagcgactttttctcgtcctccgccaacggcataaaccagtttaccgacagcattaagctgtggtaccccttgccccaactggaggatcccgtggccaacttcaccgcctggacgtggacctcgcaggttttccaggccgactactatcaggcccaaattgcgttttaccgacgcggatctggtcttcccaacagacagatgggctctttgtactggcagttcaacgacatctgggtcggcccgacctggtccagtacggagcacaacttgcgccaaaaggtggcctactatgcggccaaggacatcttcaatcccgtcattgtctggccgttttacgacgaggccaccgatgtcctggaggtgtgggttgtttcggatctgtgggagaaagtttccggaactgccaccttccagtgggtcgactggaagggcaatgcgctggatgttggtcctcctgtccacgtgaagcctgctcgcgatggatcgttcaaggtcaacttcgacgtgcagcccatcaatgccacccggctggtcacatatcctgccttgtcaacctttttcgcctgcaagaacccgttgtcgaatgcgctactctcaatttccgtcaaggccggtgaatatacccactccaagttctttcaccctcaaagcctccgattgagcagcattgccgacccaggcctggccatgaccaagtcgcttcgaggaaagacggcccagttcaagatcaccgccaccaagggtgttgcggcatgggtgtgggtcgactacccctccactgtgaggggatactttgaccagaacggcttctggcttcacaagggcgagagccgtaccattactttcatcgtctgggacgactggtccagtggtgcatggatcaatgatgttgttctcagatccatatatgacaatgtggacaagtag

SEQ ID NO: 39 - protein, 927 aa, Trichoderma reesei QM6a
MGRFLAALWLAASCVTAQSIFNLSDVSWTVSNGVNATVPGKLPSYAHIDLLAAGVIDDPIYGFNEWNQFWVQRMNWTYTSGPIKGLKSGEELTSWLVFEGLDTFCEIKLCGQKVGDTKNQFRKYTFDVSDILPKCKGDPVLSLNFGSASKIVLDISQRGDLCTLISMPVSCESLSAYMFCRVYMRKQESDFGWDWGPQFAPAGPWRPAYIVQKGKTDPVYITNTAIDIYRQGQMPNLSPDQSKPWVFNASIDYIGTLPKGSQFHVKIVDSKGHTLKEANLVGITQSDGTITGSTAINTKVDLWWPSGYGEQPLYTATLSLISAGVSKHATVTKRVGFRTIVLNLNAITEADKAKGVAPGASWKFEINGHEMYAKGSNFVPPDVFWPRVNQTKIKETFELAINSHFNMMRIWASGAYLPDWAYDLADEMGLLLWSEFQFSVAYFPATPDFLAEYEAEAYYNTRRVNHHPSLALWAGGNELEYLIYGWWLNPRNNTQLEDYETIFQQHLAKCVYANTHSISYIPSSTYHGYTSLDFNSVSPQTSRYDYMESPDAIYHDTDFYNYDGSIAFQYSGYPVGRFADEFGFPSMPSVYSWRDAIPESEFNFDSSYVRHHNRHLSGGSDFFSSSANGINQFTDSIKLWYPLPQLEDPVANFTAWTWTSQVFQADYYQAQIAFYRRGSGLPNRQMGSLYWQFNDIWVGPTWSSTEHNLRQKVAYYAAKDIFNPVIVWPFYDEATDVLEVWVVSDLWEKVSGTATFQWVDWKGNALDVGPPVHVKPARDGSFKVNFDVQPINATRLVTYPALSTFFACKNPLSNALLSISVKAGEYTHSKFFHPQSLRLSSIADPGLAMTKSLRGKTAQFKITATKGVAAWVWVDYPSTVRGYFDQNGFWLHKGESRTITFIVWDDWSSGAWINDVVLRSIYDNVDK

SEQ ID NO: 40 - DNA, 1903 bp, Trichoderma reesei QM6a
  CDS (1)..(890)
  CDS (946)..(1633)
  CDS (1700)..(1900)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49709.1 (105832)
  ref <309>: DATABASE ENTRY DATE: 2006-10-18
atgagcccgaaacccgtcatcggccttttgggaggcggccagctgggccggatgctgtgccaggccgcggctcccctcgatgtcgaaatcgccatcctcgacgccgagaatgcccccgcgaagcaggtcaaccacaacaaccgcaacatcaatggctcgtacaaagacgcggagaagatcaaggagctggcctcccactgcagcgtcctcagcgtcgagaccgagcacgtggacacgacggtgctggaagagattgcgacgactacaaaggtggccgtgtgcccgtcatggaagacgattcgactgatccaggacaagtacgagcagaaggcctacctggccagcaagggaattcccgtcgctgagtcggtggctattgagggatctggcgatgccatgctcgcctctctcaaagccgtgtctgccaaattcggctatccctggatgctcaaggccaggaaggactcttacgacggccgagggaacatgaagatctctggcgaagccgacctcgaacatgctgtcgccgagtttggcaagtttagctgctatgctgaaaagtttgtcccgttccaatgcgagctgtctgtcctcgtgattcgcacggaagacgacgacggccagaccaagcgcctgctgccgtatcccgccgtcgagacggtacatgaagacaacatttgctcacgagtctacctgcctcctcggaccactcctgcttctgcctgcgagcaggcacagaaggtcgccggcgacgtcgtcgacaagctttggggaagaggcatcttcgctgttgagatgtttgtcacccaggacaaccagatcctcgtcaacgagattgccccgcgaccgcacaactctggtcatctgttcattgaagcggttccatacatgtacgtattcacccgttgccctgttggttactgctctaacaaggctgtatattaggtcacagtacaaggcacagctcacctcgatcctcgaccagactctcccgcccaaaattgagccgtacgttgcttcgagtatcatgatcaacattctcggaggcgccaatcccgactcccacctcccgcttgtcgagaaagccaagtccatgtacggagacaagatggctgtttacgtccacctttatggcaaagagtccaagcccagccgaaagattggacacatcacagttactggcttggtggccagcatagcggagctcgaagagtttgcgaaaccgctggtggacatggccagcgacatcagacaggagaggctacaatcgcgcaccaaggcattgcggccagaccaggcggtttccaagcccgctcaggcgccgctggtccttgttacaatgggctcggactcagaccttcctgtgcttaaggctggcatcgacatcctgaaccagtttggcgtgccctgggaagttgacatcacatcggcgcatcgcacgccggccaagatggctgatgtcgccacgaaagccgctgctcgcggcatcaaggtcatcatcgccgcagctggaggagcagctcatttgcctggaatggtgtcggcctacacgccgctccccgtcattggcgttcccgtcaaggccacacacctcgatggtgtcgattctctctactcgattgttcagatgccggtaagtgcacataaactttttggatccctttcctcttccttgtacgtgaagctgacgagcgtatagcgcggtgtaccgacagccacggttggcatcaacaactcgaccaatgcagccctcctcgcaatcagatgcctcggcgcctttattcccgaatacctcgagaaaatgaaggcgtatcagctggacaacgagaagcaagtggaagagaaggcgaaccgactgcgggagatgaacgtcgaggcctaccttgcgcaaatgaagaaatga

SEQ ID NO: 41 - protein, 593 aa, Trichoderma reesei QM6a
MSPKPVIGLLGGGQLGRMLCQAAAPLDVEIAILDAENAPAKQVNHNNRNINGSYKDAEKIKELASHCSVLSVETEHVDTTVLEEIATTTKVAVCPSWKTIRLIQDKYEQKAYLASKGIPVAESVAIEGSGDAMLASLKAVSAKFGYPWMLKARKDSYDGRGNMKISGEADLEHAVAEFGKFSCYAEKFVPFQCELSVLVIRTEDDDGQTKRLLPYPAVETVHEDNICSRVYLPPRTTPASACEQAQKVAGDVVDKLWGRGIFAVEMFVTQDNQILVNEIAPRPHNSGHLFIEAVPYMSQYKAQLTSILDQTLPPKIEPYVASSIMINILGGANPDSHLPLVEKAKSMYGDKMAVYVHLYGKESKPSRKIGHITVTGLVASIAELEEFAKPLVDMASDIRQERLQSRTKALRPDQAVSKPAQAPLVLVTMGSDSDLPVLKAGIDILNQFGVPWEVDITSAHRTPAKMADVATKAAARGIKVIIAAAGGAAHLPGMVSAYTPLPVIGVPVKATHLDGVDSLYSIVQMPRGVPTATVGINNSTNAALLAIRCLGAFIPEYLEKMKAYQLDNEKQVEEKANRLREMNVEAYLAQMKK

SEQ ID NO: 42 - DNA, 1670 bp, Trichoderma reesei QM6a
  CDS (1)..(167)
  CDS (224)..(307)
  CDS (367)..(550)
  CDS (617)..(1009)
  CDS (1074)..(1667)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49712.1 (59190)
  ref <309>: DATABASE ENTRY DATE: 2006-10-18
atgcctgacatcaacaccgaaaagggccagctttctcaagaggaactcgttgaaacaacggaatggcgagcccgcgaacggagactggtccgtaaacttgacatgaccctgctgcctgtggtatgggttctatacttgttcaactacctcgaccgaaacaacatctcgtatgttccttacatgagccaacgatgctctactatgtgctaacggagcgtcatagtcaagctaggctgaactcctttgagaaggacctcggattaaagaacgacgacttcaatactgctgtatccatcctgaatgttgggtcagtccgtgctcgagttccttcctactctgatcgtaatgagtctaatccggagacagatatatgcttgcccagctcccctccaacatgctcatcacccgcatcaggcctagcatttatcttcctacctgtgtcgctatctggtcatgcgtgtcagcctccacagcagcagtaacaagttatggaggcctggttacagttcggttctttctcggaatcgttgaagctcctttcttccccggtgtgagttatgactgaatgcctctagaaagacgaaaaagagacgtgctgacctctgcttaccgacaggccttctatctcttatcctgctggtacacaaggaaagaactagctctacgcactgccgtcttgtactctggccttgttctagcaaccgcgttctcgggcttgattgcggccggtgtcttctcaggtcttgatggagccagagacatcgcaggctggcagtggctcttcatcatcgacggcgcgggcagtttccttgccgccttggtcgccttcttccttctgcctgactacatagagtccaagactggaagcggcaaatggctcttcacaaaggaagagcgcgagctggctgcaaagagaatggctcttgatcgtgtgtccctcccagaggctgaccggtctgtttggtacggcgtgcgcctggccctcaaagataccaggacttggatatttgtgagtcacctttttatcatacttaacacatatatgttgcattgcttacctagtgtgtcttcaggtgctcctcctttgctcaaaccacactgcctacggcttcaactacttcttcccgaccatcgtcagcggctttcacattggctcacagaccatcaccctcgtcctcacggcccctccatacctctttggcgccgccgtatcgtttgcagttgcttactcgagcgaccgccgcaacgaacgaagctaccacatctcgatcccaatggccgttgcagctgtaggcttcatcatctccacggcaacgctcaacattggagcgcgctactttgcatctttcctctactgctctggcgcctttgcagccaacgccatggtatattcgtgggctgcgagtactctcaaccagacgcccgagaagagggctgctgcgacggccatcatcaatcttcttgcccagctgggtaatatttggagcccatatttcttccgtccacaagatgaacctcggtatgcccttgccatgattctgatgatggtgttttcattcattagtattgggtgctcctcgttgcttaaagtcttgcttcggagagagaatgtcaagctgctgagagaggcagaagtctctggacagagggtcacattatatactctgtaa

SEQ ID NO: 43 - protein, 474 aa, Trichoderma reesei QM6a
MPDINTEKGQLSQEELVETTEWRARERRLVRKLDMTLLPVVWVLYLFNYLDRNNISQARLNSFEKDLGLKNDDFNTAVSILNVGYMLAQLPSNMLITRIRPSIYLPTCVAIWSCVSASTAAVTSYGGLVTVRFFLGIVEAPFFPGAFYLLSCWYTRKELALRTAVLYSGLVLATAFSGLIAAGVFSGLDGARDIAGWQWLFIIDGAGSFLAALVAFFLLPDYIESKTGSGKWLFTKEERELAAKRMALDRVSLPEADRSVWYGVRLALKDTRTWIFVLLLCSNHTAYGFNYFFPTIVSGFHIGSQTITLVLTAPPYLFGAAVSFAVAYSSDRRNERSYHISIPMAVAAVGFIISTATLNIGARYFASFLYCSGAFAANAMVYSWAASTLNQTPEKRAAATAIINLLAQLGNIWSPYFFRPQDEPRYALAMILMMVFSFISIGCSSLLKVLLRRENVKLLREAEVSGQRVTLYTL

SEQ ID NO: 44 - DNA, 1551 bp, Trichoderma reesei QM6a
  CDS (1)..(86)
  CDS (148)..(672)
  CDS (724)..(859)
  CDS (916)..(998)
  CDS (1072)..(1236)
  CDS (1287)..(1548)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49897.1 (59351)
  ref <309>: DATABASE ENTRY DATE: 2006-10-18
atggccaagggctcatccaatgcctatgatgctcatactaatccatcgggcatgatatctctcggagtagcagaaaacagactcatgtgagacctgtcctgaaacgaatcgcgaaattgaaattcaatactcatcatctcgcaacaggcacgatgagatcgcagctcacatcaactctcatctgtccatcaccaagcgatgcctgacttacggcgacgggtcagttggctccgaccagctgaggcagagcatcgccagtttcatgaacagaacggcatttcgccccagaacacccgtagagatgaagcacgtcacggtcctttcaggcgtctcatccatcatcgactgtctcgccttcagcctctgtgaggctggagagggagttttgcttgggcgtccgacatatgtaggattcatcagcgacctcgtgagccgtgcgggagtgaaacccgttctcgtcgactttgagcgccgatcaaagtctgttcatcccttgtcgatggaggctgtcgagtgctatgagaatgccttggttgaatctgcgcgaaatgggacaccggtgagagcgctgcttttgtgtcaccctcacaatcctttcggattatgctatgaaactcaggtgcttgaggcgtatctggacctgtgcgcaaaacacagtattcatttcatcaggtatgtccttgatccagacatatgagacaagtgtgctcagacatctgccagcgacgaagtgtacgccaattctatttttgctagcacagactttccctcgcccccatctttcacatctgtcctctcactagacatcacaaagcacatcgacccctcaatggttcattgtttgtacggcatgagcaaggtaagtctgtttaaaccaagcactacttcatgtcatttctcaccatacagctgtaggatttctgctccaatggcatcagactaggggccttcgtctcccaagataatcccgatttgcaggcatccatgcgcgcgatatcgtgagcagctcatagccattgcccttgagtacctagtagttcgtgatgaacactaaatctgatgatgacgcagaaaatttgcttggccatcctctttggcggacgctgcatggtgtggcattttgacggatgaggcctttctccagacatatctcgagaccctggccaaaagattgtctgccgcgtacgagcactgcatcgcgctgctgaagcggcacaacatcccatatgtaccggcgtaggtcatcacaatcgtcacgagtggcgcaggtgtctgacttatcacagtcatgctggaccattcatctggattgacctttcgaaatatctctcttcgcactcagtcgaagcagaacgacagttggcgtggaagatgattcagaacaaagtatggctggcaaccggagaggcatatcgctcggagcggccaggctgctttcgcatcactttcgctgttgacaaggccgagcttgaactggggatgcagaggtcagttcatgcccccattatgagaagcctcctaaatactaatgagtctgccgtagagtggtag

SEQ ID NO: 45 - protein, 419 aa, Trichoderma reesei QM6a
MAKGSSNAYDAHTNPSGMISLGVAENRLMHDEIAAHINSHLSITKRCLTYGDGSVGSDQLRQSIASFMNRTAFRPRTPVEMKHVTVLSGVSSIIDCLAFSLCEAGEGVLLGRPTYVGFISDLVSRAGVKPVLVDFERRSKSVHPLSMEAVECYENALVESARNGTPVRALLLCHPHNPFGLCYETQVLEAYLDLCAKHSIHFISDEVYANSIFASTDFPSPPSFTSVLSLDITKHIDPSMVHCLYGMSKDFCSNGIRLGAFVSQDNPDLQASMRAISKFAWPSSLADAAWCGILTDEAFLQTYLETLAKRLSAAYEHCIALLKRHNIPYVPAHAGPFIWIDLSKYLSSHSVEAERQLAWKMIQNKVWLATGEAYRSERPGCFRITFAVDKAELELGMQRSVHAPIMRSLLNTNESAVEW

SEQ ID NO: 46 - DNA, 1538 bp, Trichoderma reesei QM6a
  CDS (1)..(229)
  CDS (282)..(496)
  CDS (596)..(1038)
  CDS (1121)..(1329)
  CDS (1393)..(1535)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49714.1 (121136)
  ref <309>: DATABASE ENTRY DATE: 2006-10-18
atgcgtgcttctttgccctcactgctgctggctgctgtagccaccgtaacagcacacatccacgacaaccacgcgagggctcatgaagaacatgccagagcggcggcggttgatacttcaacactaaaggggaaatggctgtacggctaccagggctggttccgcaagccagcggcgggcgtcaacaaccactggtctccaaacggcggaactcccggtcctggaaatggtatgtctggtcaccaactgaagaggagaagacagtctctaacagtcaatagtcgaattcgagtttgtgcccgatgtcagccagtatccggcaaactgcctcttcgcttccaccctgacggcacccaatgggcagccggtgcagctgtatgacaatacctgcgagggagttgtcgatttgcatttcaagtggatgcagcagtatggacttgacggagtcattgtgcagcgattcttgagtcacttggacgatgcctccttcatcacggtgagtcaatcgcacagttcccatccgcattgagccgagtatatacacaagcaaagcggactcaaccgtccagatgggactcccagctaacatcaacagatcctcaatcaagtcgaagccgccgccgtcaagtacggccgaggcttcatggtggaatacgacgcctcgggcggcaactcggccaccggcagcgtcgccgcccagatcctggccgactacaacaccaaggtgaagccctacacctcctcgcccgcctacctccatcacaacggcaagcccgccgtcatggtctttggcgtcggcttcccgacggtccacatcaacgtcacggacggcgccaacattgccacgcagctcaagggcgctggggcgtacgttggatacggcgtgccgtcaacctttggggcggaagtcagggccaatacggggtttgcgtcggcgtacaaggcggccaatctgattagtccgtggacggtgggcagttatagcgagggagggtataagaacggttaccacacgacgacgcagatacccgactctcagtgagtgctatctttactttctggaactggcagttctgatcagttcggggtgtcgaaacttgtcaactaacgcgacaaaaagaaccctccagtccctcggcatcgaccatgctcccctaatctggcccggcacctctgcctaccacctcaacggcgtcacaacgccggccaactttgactacttcccgcgatacaatggctctttttactcgatgcaggccgacgccatcacgtccctgccagtcaagccgttgtttgccttcaacgccatgtttgacgagatcaacgaaggtttgtctcatcatccacttgcaactacagctgaccaattctaacgttctcttacttgtgtaggaacccaaagtctgccttgcctaaagacgaatcaactccccaccaacgaaaagttcgtcggctacgacaacaccttcgctgacacttcattctacctggaactcgggggccaaaaagccgctgcctttgccgcggcagtgaaataa

SEQ ID NO: 47 - protein, 413 aa, Trichoderma reesei QM6a
MRASLPSLLLAAVATVTAHIHDNHARAHEEHARAAAVDTSTLKGKWLYGYQGWFRKPAAGVNNHWSPNGGTPGPGNVEFEFVPDVSQYPANCLFASTLTAPNGQPVQLYDNTCEGVVDLHFKWMQQYGLDGVIVQRFLSHLDDASFITILNQVEAAAVKYGRGFMVEYDASGGNSATGSVAAQILADYNTKVKPYTSSPAYLHHNGKPAVMVFGVGFPTVHINVTDGANIATQLKGAGAYVGYGVPSTFGAEVRANTGFASAYKAANLISPWTVGSYSEGGYKNGYHTTTQIPDSQTLQSLGIDHAPLIWPGTSAYHLNGVTTPANFDYFPRYNGSFYSMQADAITSLPVKPLFAFNAMFDEINEGTQSLPCLKTNQLPTNEKFVGYDNTFADTSFYLELGGQKAAAFAAAVK

SEQ ID NO: 48 - DNA, 1362 bp, Trichoderma reesei QM6a
  CDS (1)..(1359)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49899.1 (59558)
  ref <309>: DATABASE ENTRY DATE: 2006-10-18
atggctttccatagagtgggaaactacacattccagtggacagaccttcacttacctcgagagaagacggaccccctgcgccacgagtacgacacactggggcacaatgcggtcaagaggctgcagcaaattgcgcggcaaagaaagggagaggcatccgtcaagcccaccctctgtcccggcggcttcgacatgtatgccgttctccgcgattaccatgaccaagacgacgtcttgaaccggctgtggaacgaggttcatacagttcctgactgggtggactgggcgcagattgaacgtgggcaaaagttcttttaccgctacgctcccgccaacctgatgggtttcatgctgcaggcattcgtgggcgagaactcttcggtacctggcgtcgtcgaagtcttggtgcgaacaggcgggttctcgacgaaggtactgctgcgtcgactactcgagaccttccagcatcttcttcaggtgacggccaacttagagtcaattcaaccggggggccaaggccacacaacgacggttcgagtgcggctgctccatgctgctgtgagagagcgaatcctgcgtctggtcaagagtcgacctgactactttgacgtggccaagttcggagtgcctgtcaatgttctggactcgatccattccatttgtgtgtactcttgtggccacatgtggctccaacttccgcagatgggggtgtttcccactgagcaggaaaagaccgactacatcgcgctgtttcgctatgttggatatctgctagccactcctcacgaatacttctcgagcgtggcgcaggccaaggccacgatggagagcatgctgctgcacgagctgcaagtcaccgagacgtcgcggatcgtgggccacaatatgatcgagtgcatcaaggaccgggctccattacgcgtgtcggtaggcttcatagaggctgggagtcgaatcctcaacggcgatgagctttgtgattccttgggcttggggaagcctggatttctggcatacggttgctggagaggccattgctggttcgttcagagtctagctcttgtgcaaagatgggttccaggggccgacgaggcggtggtgcgatactttagaaacacgctgtatgagacgcttgtcaatagcaagagggaactcaggggaagatcggagatggactttaggcacgtcccgcagatgggcaagcggattggcaaagagggcagcgaactgccgaaattcaccggctcacttgtagatcgaccgctggagatgttttacctggcggtgtttggattgggatgcgtactttggctgggagtcgtaggtgcgatactgcggatgcatttgttgatgctgtcgtga

SEQ ID NO: 49 - protein, 453 aa, Trichoderma reesei QM6a
MAFHRVGNYTFQWTDLHLPREKTDPLRHEYDTLGHNAVKRLQQIARQRKGEASVKPTLCPGGFDMYAVLRDYHDQDDVLNRLWNEVHTVPDWVDWAQIERGQKFFYRYAPANLMGFMLQAFVGENSSVPGVVEVLVRTGGFSTKVLLRRLLETFQHLLQVTANLESIQPGGQGHTTTVRVRLLHAAVRERILRLVKSRPDYFDVAKFGVPVNVLDSIHSICVYSCGHMWLQLPQMGVFPTEQEKTDYIALFRYVGYLLATPHEYFSSVAQAKATMESMLLHELQVTETSRIVGHNMIECIKDRAPLRVSVGFIEAGSRILNGDELCDSLGLGKPGFLAYGCWRGHCWFVQSLALVQRWVPGADEAVVRYFRNTLYETLVNSKRELRGRSEMDFRHVPQMGKRIGKEGSELPKFTGSLVDRPLEMFYLAVFGLGCVLWLGVVGAILRMHLLMLS

SEQ ID NO: 50 - DNA, 2972 bp, Trichoderma reesei QM6a
  CDS (1)..(150)
  CDS (320)..(339)
  CDS (632)..(2969)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49719.1 (105849)
  ref <309>: DATABASE ENTRY DATE: 2006-10-18
atggcacacgtcatgaaagctggccactcagaaagctttgttcttgcacttgttgccatcttgacggaaggtttgaaacgtcatgcttctctctgccaatcggagacaaaacgtgatcagcgggagccggtgacacttgcctttgatctcgtgagttgagtcatggggttccaaatgagaatttgtggttttttgtggttttttgtggtttgtccccccctctcttcttttcttttcctgtcgtttctcaattcatttctcacttgatgctcattggcacaatcccgtggctcttcattaccttgcctctttccgccagacactcgtcttcgtgtcaatgtatgtacgacgggctgactcatcaatgctggccagatcaatgctgacgtaaaattctcatgagttcctgcccgcttcctacattgagctctttcgcctctccatcgatgaaagtgcacctttagcgacacgcatgagtcgagctttttgttctatctctcgctcaagtcgatcaaggagccaagtctctggacttttgctcacctctttgtcaatgtgcgaccatcactaaccatactaccttattgatgccaggatccgaatgagcgcaagcacgactcttcgtttgcaggccaccaggctctatcgacatgagttcatcggcttcgtctagctctgccagagccgagcgacgcaaattccgacgaggcacgacaagctgctgggaatgcaaacggcgcaaaacacgatgccacttcgaaaagagtggctcaagcgcttgcgaggcttgcgagcgccgtggatgcaggtgtgtcctgcagcatgtcgaggagccgtcttcagtcacagaggcagcggaccgttcgattcgcgctcaagatgctggacatcaattgggtcatcttgaggacttggttggtcgactggtacgtcagtcgactcttcccgctgcttcaatccgtgattctgggcatgtcctgcaaacccaaaatccacccagagaattgcagagcagtgcatcaaccaaccatgcatcccgacgaaccccacaactacaacactcttccgactctcgacgcagattgcttcccaagccgggccacaggccaacgcagagctcctttagtcactcaacggacgataatctcgagaccttgaaccaaccaactcagacctcaacaccccgtccgtcatcactggtcaatacggccgatgccttgctgctgccgcctcacccaaccaatggtgctctgcggtgcagctccgtgactatgctcttgcagtccatactcccgtccgccaacgtcaccactcgcatcatgcatcaaaacaagctgctgatgatgtcgatgcacgtcttccggggcttgtccaccgacccttttcgatctgtagcccctcgacaaatctccctcttggcttctccaatgtcgagcaacgccgacccgattgatctagctcgacgactaattcagctcgcaatctgccttcagcagtcagatcgcacatcggagatctctgcgctctgcctcgatcggtcgaatagtgacgttgccggccaattttttgaggctgcttctcgttatgtcacctctcaggactctcttgtcgtctcctttggtggcatagagacattgatgcttgaaggactttaccacatctcgacgggcgagatgcggcttgcttggctcgtgtttcgccgagcgataggcattgctcacctgctgggcctccacgtcccgcaccggcggcgtcacagcaagcagatgccgatctgcttggcgactctctggtttcgcctcatattcacggagcgctacctggcgttggtgctctgccttccaatatgtgtccgagacgatagcttcatggacgacttaaatggcctagagcctcaagaacagcttgagcgtgtccaggccaagcttacgagtcgtatcatatccaggaacgaactgatgcaacgggatcgttgcgcaaacgaccttacctacgaccattacaatgtgacgaaggacattgaccacgcgttgaagcaggcggcgcgatctctgtcagcagactggtgggcttttccgagactgaaggatgctcagaccaatgcggagctgaaaaatatgacgtccaaggttgttcttcagttgcatcattacaaccttgtactgttgcttcatctgccgtacatcgtcccgcggctcggaattggctctactagccagggcacccaagactacacaaactccaagctctccgccatgtttgccagtcgtgagctccttacccggtgcctcattccggtcagccctaatcgtgtgtccgcttcaactcgggggaataccctcaaggttatccttgctgccctggcccttctactagctcacctggatagccaccggctaggtcgcgacaatgcttttgatcatcagcgcttaatggatctattgatggtcgaacgagccattcaaggcctggaatccatggctcaaaagcacgatgatgtgctgtgcttctccgccgttctagctctgaagaggcttggcaacatggaggcaacagccgcagacggccttgatctcagcgtttggtgcgagccgagcgagctgatgcttttggagtgcttggtccgagacgaaaaggacacactcatacttgtgtttccatatgttgggaacattcacattgtgcgccagtgccatcaagatgatgcgccaataagcgaggctgcatctagcggcgtaacggagacgaccatcctcaacaatgatctttcgacttcatcgtggcctccattatccttttggcccgacttggcccccatcactcccagccttggtgatacgcagagtaccatacctgatgaccacgaaattcacaactcatacaacctaccaagcggcgatgccgagcgtgtgcatatgccggcgatgccgcggctacttttacaggacctccatgtttcagacgggatttga

SEQ ID NO: 51 - protein, 836 aa, Trichoderma reesei QM6a
MAHVMKAGHSESFVLALVAILTEGLKRHASLCQSETKRDQREPVTLAFDLTLVFVSMPPGSIDMSSSASSSSARAERRKFRRGTTSCWECKRRKTRCHFEKSGSSACEACERRGCRCVLQHVEEPSSVTEAADRSIRAQDAGHQLGHLEDLVGRLVRQSTLPAASIRDSGHVLQTQNPPRELQSSASTNHASRRTPQLQHSSDSRRRLLPKPGHRPTQSSFSHSTDDNLETLNQPTQTSTPRPSSLVNTADALLLPPHPTNGALRCSSVTMLLQSILPSANVTTRIMHQNKLLMMSMHVFRGLSTDPFRSVAPRQISLLASPMSSNADPIDLARRLIQLAICLQQSDRTSEISALCLDRSNSDVAGQFFEAASRYVTSQDSLVVSFGGIETLMLEGLYHISTGEMRLAWLVFRRAIGIAHLLGLHVPHRRRHSKQMPICLATLWFRLIFTERYLALVLCLPICVRDDSFMDDLNGLEPQEQLERVQAKLTSRIISRNELMQRDRCANDLTYDHYNVTKDIDHALKQAARSLSADWWAFPRLKDAQTNAELKNMTSKVVLQLHHYNLVLLLHLPYIVPRLGIGSTSQGTQDYTNSKLSAMFASRELLTRCLIPVSPNRVSASTRGNTLKVILAALALLLAHLDSHRLGRDNAFDHQRLMDLLMVERAIQGLESMAQKHDDVLCFSAVLALKRLGNMEATAADGLDLSVWCEPSELMLLECLVRDEKDTLILVFPYVGNIHIVRQCHQDDAPISEAASSGVTETTILNNDLSTSSWPPLSFWPDLAPITPSLGDTQSTIPDDHEIHNSYNLPSGDAERVHMPAMPRLLLQDLHVSDGI

SEQ ID NO: 52 - DNA, 966 bp, Trichoderma reesei QM6a
  CDS (1)..(963)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49720.1 (59338)
  ref <309>: DATABASE ENTRY DATE: 2006-10-18
atgtcttggatgaactccctctttgacgcgtacagacaaaggcaagctgccctcgaagcaagcgacaatccatatgccagcggcgtcgcctggatcgcgggcgagctgtcaccactggcagaggcccggatcccgatcctggaccaaggcttcctccacggcgacctgtgctatgatgttccgtcggtgtggaatagcaagttcttccgcctagacgaccacatcacgcgcttcgagtccagctgcgccaagatgaggttcaagctgccgctgcccagggacgagctcaaggccatcctgtttgacatggttgcaaagagtgggatgcgggacgcctacgttgagctcatcgtgacgcgtgggctcaagggggtgcgagggtcgaaacccgaggaaattgtcaacaacctgtacgtgatattactgccgtatgtctggctcatggacccggacatgcagtatcgcggcggcagcgccattgtcgctcgcacggtccgccggacgccgccaggggccatggatcccacaatcaagaacctgcaatggggcgacatggtgcgcggcatgcacgaggcgcgggaccggggcgccagctatccgcttcttacggacggcgactcgcacttgacagagggagcgggatataacattgtgctagtcaagaacggcgccatctacacgcctgacaggggggtactgcacgggatcacgcggaggaccgtcatggaggtagcgagggcccggggaatcgaggtccgcgtcgaggctgttcccgtcgagatggcgtacagctgcgacgagatgtttctgtgcagcacggctgggggagtgatgccgatcacggagctcgatggactgccgatcaaggacggacaagttggaccgattacaaaggaaatctgggacggatactgggctctccacgagaacgatgcgtacacgacggcggttgagtacagccagtaa

SEQ ID NO: 53 - protein, 321 aa, Trichoderma reesei QM6a
MSWMNSLFDAYRQRQAALEASDNPYASGVAWIAGELSPLAEARIPILDQGFLHGDLCYDVPSVWNSKFFRLDDHITRFESSCAKMRFKLPLPRDELKAILFDMVAKSGMRDAYVELIVTRGLKGVRGSKPEEIVNNLYVILLPYVWLMDPDMQYRGGSAIVARTVRRTPPGAMDPTIKNLQWGDMVRGMHEARDRGASYPLLTDGDSHLTEGAGYNIVLVKNGAIYTPDRGVLHGITRRTVMEVARARGIEVRVEAVPVEMAYSCDEMFLCSTAGGVMPITELDGLPIKDGQVGPITKEIWDGYWALHENDAYTTAVEYSQ

SEQ ID NO: 54 - DNA, 1731 bp, Trichoderma reesei QM6a
  CDS (1)..(1728)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49723.1 (59723)
  ref <309>: DATABASE ENTRY DATE: 2006-10-18
atgaaggccgccatcctctcaatcgcggctggcttgctgccgctcatcgcagccgtacacacctccgtacacaccttctccgtggaggcacgggaagaggccgccattgccagcgtcaccatcccgtccggcaccatcatcggcaccgcaggagagaccgtagaaacgttcaatggcatcccctatgccgatgcgccgattggcgacctgcgcttcaggccgccggtaaagctgtcccgggacctgggcacgtttgacgccacgggcacaccccgttcatgccctcagggacccatcctgactctgaagggcctctccaacgtcgctgatgctctcgttgctggcgccatcgttaacgatacctcgggcgagagtgaggcacccacatcgggggaagactgtctgacgatcaacgtccagcgcccgaaaggggtacgggccggcgccggcctccctgtgctgttctggatatttggcggtggctttctggccggcagcactgcgggctacaatgccacccagctgattgagacgggcctgctgcacgaccagccctttatcttcgtggcggtcaactaccgcgtcgctgcctggggtttcatgccgggcaaggagatcttggccgagggcagtggcaacgctgggcttcttgaccaacggatgggcctcgagtgggttgcggacaatattgaggcttttggtggtgacccgggcaaggtcaccatctggggcgagtctgccggtgccatctcggtatttgatcagctcgtcctctttgacggcgatgccagctacaatggcaattcgctgttccgcggcgccatcatgaactctggctccgcgacgcccactgatcccctggacagcgacaaagcccaggccatctacgataccgttgccgtggcggccaattgcacgggcaccgattcgctgtcgtgcctccgcaatctggacaacgacgtcttcaccgtcgccgccaactcggtgccgggcatcatctcgtacagctctctcgccctgtcctatctgccccggccggacggcagggtactgacggacagcccggacgcgctgcagcgggcaggcaagttccaccaggtgcccatgattatcgggacgcaggaggacgagggcacgctcttcagcctgacgcagcgcaacatgagcacgacggagaagattgtcgagtacctgtcggcgtactacttccacaacgctgatacagagcaggttacggagtttgtcaacacgtacagcagcgaccctcgcgacggaagcccgtaccgcacggggtatctgtttgaaggctatcccggcaagaagaggattgccgcgatactgggcgacattgtctttaacctggtccgccgcatctcgctgcagacgtttgccagcgttgcgccgacggtgctaacgtggtcgtacttttcgtcgtacaagtacaacccgctgctcgggctgtttggcacgtatcacgggtcggacattggcgtcctgttcaaagactccaacgacaagtatccgaccattagcgggcggacgtactatctcaactttgtgcataacctggatcccaacattggcaccgaggtagacgtcttttggccgcagtggaagcaggacaagaagctgctgcagtttaaggcaaacagcaacgggcttctggatgatacgtatcgcaacgcgagctacacttttttgattgacaatattgaggacctgagattctag

SEQ ID NO: 55 - protein, 576 aa, Trichoderma reesei QM6a
MKAAILSIAAGLLPLIAAVHTSVHTFSVEAREEAAIASVTIPSGTIIGTAGETVETFNGIPYADAPIGDLRFRPPVKLSRDLGTFDATGTPRSCPQGPILTLKGLSNVADALVAGAIVNDTSGESEAPTSGEDCLTINVQRPKGVRAGAGLPVLFWIFGGGFLAGSTAGYNATQLIETGLLHDQPFIFVAVNYRVAAWGFMPGKEILAEGSGNAGLLDQRMGLEWVADNIEAFGGDPGKVTIWGESAGAISVFDQLVLFDGDASYNGNSLFRGAIMNSGSATPTDPLDSDKAQAIYDTVAVAANCTGTDSLSCLRNLDNDVFTVAANSVPGIISYSSLALSYLPRPDGRVLTDSPDALQRAGKFHQVPMIIGTQEDEGTLFSLTQRNMSTTEKIVEYLSAYYFHNADTEQVTEFVNTYSSDPRDGSPYRTGYLFEGYPGKKRIAAILGDIVFNLVRRISLQTFASVAPTVLTWSYFSSYKYNPLLGLFGTYHGSDIGVLFKDSNDKYPTISGRTYYLNFVHNLDPNIGTEVDVFWPQWKQDKKLLQFKANSNGLLDDTYRNASYTFLIDNIEDLRF

SEQ ID NO: 56 - DNA, 1608 bp, Trichoderma reesei QM6a
  CDS (1)..(243)
  CDS (352)..(1605)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49906.1 (59188)
  ref <309>: DATABASE ENTRY DATE: 2006-10-18
atggcgtcgtacctgtcccagctccttggcctcgggcccaaaagacgcgcacccgcgatcgtgcccaccgacgagattgtgcccctgcacctgttcgacgatacggccaccttgcggggcttcacgctcatgtggaccttcaagttcgaccaggtgctcgatgcagacaagctgggcgattcgctctcgcagctcttccagatggagggctggcgaaagcttggcgggaggctacggctcagggtgagtagtcggaaccgtgttcgttacaatggcatcgagcagcaagatcgacatcaagaacaagatgatctcaagtgaaagccaagcacaagctaacgctgaggccagcccgatcgatcggcagaaattcacatcccatgccctttcaccaaggatcgaccgccgctccacttcacaaaggcgagcttcaacatgcgcatggcggagcatcccgaagcatcaaagctgccatctccatcagacagactcacgacctttccaagccctcgcaactaccaatctctagcccttgggccaggggcgcctaggtgcatagacgattatctgtattcggatgctccgctgtacgccctccatgttgtcaactttaccaatggaaccctggtttctatcaccttcaatcatgtcatcagcgatctcgccggactgatggccgtcatgaaggcgtggcagctcgtgttggcaggcaagcccgaggccgtcccgacgttcaagggcttctacgacgactccatggccggactctacaaggcgcagccggctgaaaggtatgtcctggccgacaagcaactgacgggctggcgacttgcggcgtttggactgcgactcatctttgactcgtggtggaactctccgatccattccaggcttgtctgcattcccaagaggaccatcgacacacttgttcaggcggccagggaccagatacccaaatccacggacaacatcaacggcgctgctggttcatcatcctcgttcatcagtgaaaatgacatcattgtagcgctgtccatgaaggcgatggcgcatagccttgcccccaaccgagccatcatggctctgcaagctgttgatccccgcagtcgagtcaagtcggtttttcagcaagacgccgcttatgtttgcaatgcgcctgcagcagcatttgtgcaatgcatcagtcgagaaacggtcgacatgagcgttggggagctggcgcttgagggcagaaaggctctcctgtcgcagcttacagaggagcagatgaaggccgtggctgcgctggcatacaagtccatgctgagcaatggcaaccctcctgtattcggagatagcgatatggctttcctcgtcttttctaactggagcaaggccgcctttctggagaaggtggattttggcgcagccgttgtcgaggcgggtctgtcccaggacaagccggcccgacccgtttactaccactcccagagcctagaaaggggctcctttgccacgaacgtcattgtcatcatggggagagacttggaggggaatttctggctgaacggagaccttccagctcacgtctggccgacgatgctcgaacacttggagaagtttgcgtag

SEQ ID NO: 57 - protein, 499 aa, Trichoderma reesei QM6a
MASYLSQLLGLGPKRRAPAIVPTDEIVPLHLFDDTATLRGFTLMWTFKFDQVLDADKLGDSLSQLFQMEGWRKLGGRLRLRPDRSAEIHIPCPFTKDRPPLHFTKASFNMRMAEHPEASKLPSPSDRLTTFPSPRNYQSLALGPGAPRCIDDYLYSDAPLYALHVVNFTNGTLVSITFNHVISDLAGLMAVMKAWQLVLAGKPEAVPTFKGFYDDSMAGLYKAQPAERYVLADKQLTGWRLAAFGLRLIFDSWWNSPIHSRLVCIPKRTIDTLVQAARDQIPKSTDNINGAAGSSSSFISENDIIVALSMKAMAHSLAPNRAIMALQAVDPRSRVKSVFQQDAAYVCNAPAAAFVQCISRETVDMSVGELALEGRKALLSQLTEEQMKAVAALAYKSMLSNGNPPVFGDSDMAFLVFSNWSKAAFLEKVDFGAAVVEAGLSQDKPARPVYYHSQSLERGSFATNVIVIMGRDLEGNFWLNGDLPAHVWPTMLEHLEKFA

SEQ ID NO: 58 - DNA, 2262 bp, Trichoderma reesei QM6a
  CDS (1)..(2259)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49726.1 (59665)
  ref <309>: DATABASE ENTRY DATE: 2006-10-18
atgcttcgagagttcatcacctcgctgctgctcctcgtgagctgcggaaacgccgcccttcactcacggcacaacgacacatcatcgtgctcagcacgaacactgcatcttagtgatccgccctatcaggattacttttactcagattgccacgtcgacgcacaagctgtcgtcaccagtcccctccccaacagcaatctttccatcataggccctcgatttatcgtcgcctggcctgctggcaacagtggcatctgcacctttttccaaccgcagagcggcataaacggtagtcttgccattgagcttgtcaactccacgttagggagccctctaggccctgtctaccacaagacaaaccaatcagctccccctattgtgggtgtcgagggcgttctctcattcaatgactcggctgagctgccaattgctattcttggtagcgtcaggaacatccgtgatttcacagaaggcccaagtctgctcagctctgtgatacaagccggcatcaaagtcaccaaatatcagcataacggtgcgaaaatcactcgaaggtggctagacaacgtcactaccactacgtttacgcttgttccctggaaaaacagcgacagccacgttcgaatccacaacaaaacgctgcggtttggttccggcttctaccacttcactgcctccttcaactatcctcagctcaagcagttgaccccgagccagatattgaacaaccagtcccaggcacttgtcaaacaacagccggggactgtttcatccctatcattcttctcatacacagagaagcttcttgcaggaggatggaggtttctcacatactttggtcgtgacagcatgatctcagcactcctactccagccgattctcagcaccggcaacggttctgccatcgaggcagtcataggagcagcgcttgaacgtgtcaatcgaacggacggctctgtctgccacgaggagactattggtgactacgcgacatttgtcaatctgcaaaacaatatcacatctacagccgccggcttcacgtacccaatgattgacacagactactatctccccattctcatggcacgatactttggctcttctcctgatcgaatcagcccaatgctcagcacaagggccggaaccattgatgtcagtaatgccaatctgacttggggtgatctgagctacaccactgccagcaagatcttgaacctcactgcagcattcgagcacaaccaaacagtggagaatctcatcgctctcaagccagaccagatcgtaggtcagtggcgcgattccacatatggtctcgccaacggccgcattccgttcgacgtcaactgtgctctagcaccggctgccctgtatgcaatctccagcttggcagccatccccggcgtctatcccaacatctccatcaccagagactgggcgacggtggcggcgcggagggccaaagtatgggaagacaagacgctgcagttcttccagcacaatatgactacgcagaccgccgagacaaggctgaagcagtacaccagcaagagcacattctacaagggccctaccaatggcgattcggtgtcgaactattccaccaatggcaccgtgattgactacggcttggccatcaacagcaccgccacgccagagatcattccaatttcacatacggatacggcctttcgtcattatctcctcaacacgacagacgaagagcaactgacaacattcatcaacgcctctgcgaatgccatcttgcgtccgttcccggctggcctgagtactccggtaggcgtcgtcgttgcaaaccccgccttgtccaacaacgaggtgctcattgccaacttcacaaactctgcctaccacggcacagtcgtgtggagctggcagctggcgttgatggccaaggggttcgaaaggcagcttgagcggtgccaaggcgtgaatgcgacggatatcccgttgtccgtgacgaatgccgccacaatcccccaattctgcagcgacaagggcgtatttggcgcactgaagaaggcctacaacaagctgtgggatatcattgacgacaacgaggagcagctcgaatccgaggtatggagttggacgtataatgatggatcaacacgcggtttcgagttctctcctctgggagttcttcctcctccgcccggagtgggaggcggaacagagagcgacgtccgacagctctggagtctgacgtttcttgctgtgaagaggaacaagagttttgagtga

SEQ ID NO: 59 - protein, 753 aa, Trichoderma reesei QM6a
MLREFITSLLLLVSCGNAALHSRHNDTSSCSARTLHLSDPPYQDYFYSDCHVDAQAVVTSPLPNSNLSIIGPRFIVAWPAGNSGICTFFQPQSGINGSLAIELVNSTLGSPLGPVYHKTNQSAPPIVGVEGVLSFNDSAELPIAILGSVRNIRDFTEGPSLLSSVIQAGIKVTKYQHNGAKITRRWLDNVTTTTFTLVPWKNSDSHVRIHNKTLRFGSGFYHFTASFNYPQLKQLTPSQILNNQSQALVKQQPGTVSSLSFFSYTEKLLAGGWRFLTYFGRDSMISALLLQPILSTGNGSAIEAVIGAALERVNRTDGSVCHEETIGDYATFVNLQNNITSTAAGFTYPMIDTDYYLPILMARYFGSSPDRISPMLSTRAGTIDVSNANLTWGDLSYTTASKILNLTAAFEHNQTVENLIALKPDQIVGQWRDSTYGLANGRIPFDVNCALAPAALYAISSLAAIPGVYPNISITRDWATVAARRAKVWEDKTLQFFQHNMTTQTAETRLKQYTSKSTFYKGPTNGDSVSNYSTNGTVIDYGLAINSTATPEIIPISHTDTAFRHYLLNTTDEEQLTTFINASANAILRPFPAGLSTPVGVVVANPALSNNEVLIANFTNSAYHGTVVWSWQLALMAKGFERQLERCQGVNATDIPLSVTNAATIPQFCSDKGVFGALKKAYNKLWDIIDDNEEQLESEVWSWTYNDGSTRGFEFSPLGVLPPPPGVGGGTESDVRQLWSLTFLAVKRNKSFE

SEQ ID NO: 60 - DNA, 1421 bp, Trichoderma reesei QM6a
  CDS (1)..(635)
  CDS (698)..(1418)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49728.1 (59669)
  ref <309>: DATABASE ENTRY DATE: 2006-10-18
atgaagatcgccatcatcggtgctggcattgccggatgcgcagtgtacctcgagctgaagaagcatctgccaaagatcgaggcatttgccgaagaccacgagatcacgatctacgaggcctacgacaccgggaaagatgtcacctcagacgatcgagaagaaggcccgacgcattcgtctacgctcatcgtcggcggcgggctgggcatcgcccccaacggtctcggtgtgatccagcgcctcgacgaagctctcctccgagatgtgacgcgtggtggatacgtgatatcgcgatccaacatgaagaacaagaatgggagcctgctcatgtgcatcgacatcaacagccccgatgcgagcgagccagcgagtcccttgaagaagctcaacatggtggcatgcagccgtcactccctttggagatgcctaaggactcgcatcccggacacggccattgtgaataagcgagtgtcgcaggtcatcgccaacccagaggggagacacgcgatccagtttgtggacggaagcaacgcggtagaggtggacctcgtgatcggtgccgacggtgtcaagtcaatcaccaagagagcgctatttcccgatgccgcagaagatccatatccgcctcattatgagtaggtgctataacgacacagatcttcaagccttgatcagcatttgctaataatgtcaaaagaggccttgtcggtatcggaggcttcatcccggccgctggtctggaagaatacgtcgagaaggggtccatgaacttcatccatggcggcaacggcttctttggctatttcttttcggagagcgatccttcggatccgaatcgcgaatctccctatgacgtgtccaagccaggagatacgctcgcctggtggtccacatatgagattaaggaatgcccggatcgcaaaactcttgatttggcagacatctccagacggctgcgggagagacatgcacagtggaaagatccagtcatccagagagtcattagaaccgcccgagtatcaaacatgtatcccacctggacgtcgccacctttgcctacctgggagtgcgatggtgttgtcttgcttggagatgcagcccatgctcttccgtcgacttccggccagggcgtatcgcaagcgttggaggactgcgaatcctttgctctatttctggcgcatcaactggcgcggggagactcgagcagtcccatgacgcagagacaggccgtcaccaaggccgcgagacagtatatggatcttcggaaaccacgcgttacagagatactcgaaagtgcgaagagaattcagaatgtgaagcgcgacatgggcatcatccgcgagtatgcaatgtattccttcttcaagctcatgggtgagttggaatgttatagactggctttcccagcaattagaaactga

SEQ ID NO: 61 - protein, 452 aa, Trichoderma reesei QM6a
MKIAIIGAGIAGCAVYLELKKHLPKIEAFAEDHEITIYEAYDTGKDVTSDDREEGPTHSSTLIVGGGLGIAPNGLGVIQRLDEALLRDVTRGGYVISRSNMKNKNGSLLMCIDINSPDASEPASPLKKLNMVACSRHSLWRCLRTRIPDTAIVNKRVSQVIANPEGRHAIQFVDGSNAVEVDLVIGADGVKSITKRALFPDAAEDPYPPHYEGLVGIGGFIPAAGLEEYVEKGSMNFIHGGNGFFGYFFSESDPSDPNRESPYDVSKPGDTLAWWSTYEIKECPDRKTLDLADISRRLRERHAQWKDPVIQRVIRTARVSNMYPTWTSPPLPTWECDGVVLLGDAAHALPSTSGQGVSQALEDCESFALFLAHQLARGDSSSPMTQRQAVTKAARQYMDLRKPRVTEILESAKRIQNVKRDMGIIREYAMYSFFKLMGELECYRLAFPAIRN

SEQ ID NO: 62 - DNA, 805 bp, Trichoderma reesei QM6a
  CDS (1)..(604)
  CDS (660)..(802)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49908.1 (105866)
  ref <309>: DATABASE ENTRY DATE: 2006-10-18
atgagtgacatcgaagacaccgttcaagccgaagagggagatcgtctcgccagtctcctgagcctatgcccgcgctatatcgttgttccacccaaccccccagatggcattgcttttgccatgacgggagactgtcaggattgggaccaattgacctactggcactctggcatctccaactgcaagcctggcatctggagggcagagatcaagagaattcctggtgcccatgatggagatgccgactacgaagcctgtcttcgttgggtggcagatctggacgatgatactgagctcgactttggcgcctcccttgatgagtggcaagcctgggagcaaatgttcaaagacaagttcgacgggtctctcgagtgggatagcggcatcatctggaagcacggcggcacttactacgacgacggcggcattttcaatgtcatttccacggcatatctgacccatgaggcggcagccaaggtgctaggggacgattacaacgaagacgaatatgacggctatctggagatgattaccctcaatgataaccctataaacgaggaagacagccagcggaattacggcttcacacttggaggactacactgtaggtcattatccttcgtatgatgcgcagatgctgactttgttttgcgtgtcagttgggcaagacagtatcggtggtccgcctgcgattgctctggctgaaaaggatggccaagtcgtcgccatcaagctctggagcgacgatgccgagattgaggagggcactccccttgagaagcagcccggccagctcgtcttttag

SEQ ID NO: 63 - protein, 249 aa, Trichoderma reesei QM6a
MSDIEDTVQAEEGDRLASLLSLCPRYIVVPPNPPDGIAFAMTGDCQDWDQLTYWHSGISNCKPGIWRAEIKRIPGAHDGDADYEACLRWVADLDDDTELDFGASLDEWQAWEQMFKDKFDGSLEWDSGIIWKHGGTYYDDGGIFNVISTAYLTHEAAAKVLGDDYNEDEYDGYLEMITLNDNPINEEDSQRNYGFTLGGLHFGQDSIGGPPAIALAEKDGQVVAIKLWSDDAEIEEGTPLEKQPGQLVF

SEQ ID NO: 64 - DNA, 1058 bp, Trichoderma reesei QM6a
  CDS (1)..(483)
  CDS (592)..(814)
  CDS (886)..(1055)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49916.1 (59700)
  ref <309>: DATABASE ENTRY DATE: 2006-10-18
atgtctcttaatgtttctcctcaaaccaaaaccattcacaaagccgcatatccagccattgcagcctcccgccctgagctctcccaacaagatcgcgtcgtctacgtaacgggaggctccgcaggtatcggcttcgccatctgccacgcctttgccgacgcccaagcggccaccgtcatcctcaccggccgtcgtgaggctgctctgagcgaggccgtcgatgccctctccaaggagcacccaaagaccaagttcatcggccaggtactcgatgccgctgatcgtccggcaacggaaaaggcctgggctcagcttgagaaagacggcgttgtcgtcgatgtcttggttctgaatgccgcctatgtgacgcacagacaggctcccctggtggatcttccatacgaggaggcatggcccagctgggtgaccaacgtcggcgcaaactatgacctgattcaacgattctatcaccagaagaaccgtgtcccgggccaaaagctggtgagcgactgcctcgagaagccgaagcatcatggctgatttgatctctttttcttatggcctcgtgcttgacgttgacacaatgtacagtccctcgtcaacctctcgaccatggccatccacgcgttcgaacaagtcaaggcattccctgcttactgcgcctccaagaatgcggggacccttctcgtccagctctttgctcagggcgtttcccccgatgacatgcagatcctgagtttccaccccggagcaatctggacggactcggtacagaagagtggcgtccccaaggaggcttatgcatgggacgacggtatgtatagagcgctcttgtctttttctctgtttttgcatggccatagactcgctgaccgggatatacagcgacgcttgcatccaattatgccgtttgggcagcttctgatgaggccaagttcctccatgggcgatttacctgggcggcttgggatgtggaagagcttcagagcgaagagttcaggaagaggcttgaagagaagccgacgtacctccaggttggagttataggcctttcatga

SEQ ID NO: 65 - protein, 292 aa, Trichoderma reesei QM6a
MSLNVSPQTKTIHKAAYPAIAASRPELSQQDRVVYVTGGSAGIGFAICHAFADAQAATVILTGRREAALSEAVDALSKEHPKTKFIGQVLDAADRPATEKAWAQLEKDGVVVDVLVLNAAYVTHRQAPLVDLPYEEAWPSWVTNVGANYDLIQRFYHQKNRSLVNLSTMAIHAFEQVKAFPAYCASKNAGTLLVQLFAQGVSPDDMQILSFHPGAIWTDSVQKSGVPKEAYAWDDATLASNYAVWAASDEAKFLHGRFTWAAWDVEELQSEEFRKRLEEKPTYLQVGVIGLS

SEQ ID NO: 66 - DNA, 918 bp, Trichoderma reesei QM6a
  CDS (1)..(40)
  CDS (103)..(634)
  CDS (695)..(771)
  CDS (896)..(915)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49736.1 (105884)
  ref <309>: DATABASE ENTRY DATE: 2006-10-18
atggcccaatacaccgtactcatcactggtgccagcagaggtatgtatgcactcctcctacgcagaacgggagagtgtctaacaatatggacgttgggccaggcattggggcctctctagcagccaagtacctctaccgtccaagcacgacggtgattgccacggttcgaaacctcacggcggagcatgagcagagactccattctctccctcgtgggcagggatcagagctcatcctcctcgcccttgacatgaagaaagcttcgagcgccgcggatagtgtcgctcggctcgaagcggagcatggcgttcactccctggaccttgtcattgccaatgccggcatctgcgactcgtggggtccggtggctgacatgtccgaggttgagcttctgtcgcacatcgaggtcaacaccctgggcttcctccgcctgtacaaggcagtagtttcattgttggacgttgcggacgagccaaagcttgtgtacatgtctaccgatgtggcaagcatcagtcaactcagcagcgagtccatcacgaccgagtatgggatatcgaagattgcgggcaattttctgatgaggatgattagcatcgagcatagcaactggaccgtgtttgctattagccctgggtaagatacatgccggatttcttttgccatgctgtgcttgggtttctcacaaggctccaggtttgtacagacggacatggggaatcgcggcgccaaggcccatgggctggagaaggcacccgtgactgtcgaggagtgtacgtataggttgatcaagacaattgactcagcatcgaaggaggttactggaaggttcctgagtgcagagggcggagaaattccttggtaacgccggaagagttggctgcgtacgatacatagtgccaccctcgccagttgtttag

SEQ ID NO: 67 - protein, 223 aa, Trichoderma reesei QM6a
MAQYTVLITGASRGIGASLAAKYLYRPSTTVIATVRNLTAEHEQRLHSLPRGQGSELILLALDMKKASSAADSVARLEAEHGVHSLDLVIANAGICDSWGPVADMSEVELLSHIEVNTLGFLRLYKAVVSLLDVADEPKLVYMSTDVASISQLSSESITTEYGISKIAGNFLMRMISIEHSNWTVFAISPGFVQTDMGNRGAKAHGLEKAPVTVEELPPSPVV

SEQ ID NO: 68 - DNA, 1249 bp, Trichoderma reesei QM6a
  CDS (1)..(45)
  CDS (107)..(592)
  CDS (656)..(845)
  CDS (911)..(1080)
  CDS (1148)..(1246)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49737.1 (59582)
  ref <309>: DATABASE ENTRY DATE: 2006-10-18
atgtcccccagaaccatcgtcgtcgttggagccactggcctgcaggttcgtacctttaatctccagaagttgccgctaacgtattgtctaacttggtgcaaaatagggaggctctgttgtcgatgagttcctcaagtatcccgaccagtatcgggttagaggcctcactcgcaatgtctccaagccggccgccctggctctctccgcaaaaggagtcgatgttcaggccgcagacctcgatctcggccacgaagctctgcaaaaggtctttgccggggcgaacattatctttgccctgacagacttttgggcctcgagatccaaggtcgtggaagtcgctcaggggaaggccctggccgatgccgctgccaggatccccacgctggagcactttgtatggagcgctcttcctgacccgatggagctctctcgagggagattgtaccacgtgcaccactggaagagcaaggcagacgtgacggaatacatcaagacgcagaagcccgagctgtgggagaagacgacgacgattctgtttcccaactacttcgagaattgtttgacttatccccagcggtatttgcctcgtcaggtaagccttgttcatttctccagagtaccacagacgaagtcagactgatcttctgtttgggagcagatctcgggaaaacttgtacgcgagtttcccctctccgcggacacgattttgccgaacgtcgccattaccgacaccggaaagctcgttcgggccgtcgtggaggacaaaacgaagtatttcgggaggaccattgcattctggtcacagggactatcggagggcgaaaagctatctaggcttgggagcggtaggttgccgtgatgcaggttgtcattggtgaggaaccacgagagctgacaaggacactgttagaactcgtgattccgttcgagtacaagaagtcaaccccagagcagttccaacaagaactggaggcagctggcctggcaccagagactgctctagactttaccgaacagcttttgatgttcgagtatttcgggaacgtgtatgcgagccacgaccttgtccaggctagggaggtgagcatccacttgcctaggtagaagtgcgtagccgccgtggaatgctgacggaaagccgctttagatccctggcctgtcgttgaagacgtgggacgagttcatccgggagcacaaggacgagctgatggccaagattgaatcgggagacgggccatctcggtggtga

SEQ ID NO: 69 - protein, 330 aa, Trichoderma reesei QM6a
MSPRTIVVVGATGLQGGSVVDEFLKYPDQYRVRGLTRNVSKPAALALSAKGVDVQAADLDLGHEALQKVFAGANIIFALTDFWASRSKVVEVAQGKALADAAARIPTLEHFVWSALPDPMELSRGRLYHVHHWKSKADVTEYIKTQKPELWEKTTTILFPNYFENCLTYPQRYLPRQQISGKLVREFPLSADTILPNVAITDTGKLVRAVVEDKTKYFGRTIAFWSQGLSEGEKLSRLGSELVIPFEYKKSTPEQFQQELEAAGLAPETALDFTEQLLMFEYFGNVYASHDLVQAREIPGLSLKTWDEFIREHKDELMAKIESGDGPSRW

SEQ ID NO: 70 - DNA, 2442 bp, Trichoderma reesei QM6a
  CDS (1)..(87)
  CDS (208)..(317)
  CDS (440)..(510)
  CDS (652)..(1190)
  CDS (1332)..(2122)
  CDS (2202)..(2439)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49738.1 (59760)
  ref <309>: DATABASE ENTRY DATE: 2006-10-18
atgatgcaagcaatggcggctggaccccctcgcagctccaacaggggacgccgtgcgaaggcgtgtgattcgtgctcgaggagaaaggtgtgattccaccactttggttccatctccaggtggtccaacagacatgggcattgggctgcgagcttcctgagagtcctaatctacgaaaaaagaaaaattgactgagggacgcaccagatccaatgcgatgccgaggttccgcaatgcaactggtgcagacaccatgatctagcctgcacatacagtcgattagtgggcaaacccaacaagaaacggaacaggaagaggtgaagttatccttgttttgttccctcgtttgaatctcgtacccgatttcggcagagagctcgggtaagtctgccttttggcagagccttgttcactgacatgtgtcaaaaagcccagacaggaactcccagccggactccgtcacccgcatggaggccatcttgactcaacggctatcccagcatgacgatggtaggctcttgattccatttgcattctcatctctcgaatctggcctcacgatgccctcgaagtgccagttccatcttccttcgcttatacatcctcgatctgtctacatgtgctcatgattcctctctaacatttcgctagacgctcagacagaatacttggactccttccatcctcatctacgcaatgtcacgtccttcactggcatcccactcttttccgaaaggggccgggcatggatcgaatcccgtaccggcagttgcatgacaccgcggacgctgtgctcgttcggccgccagtggcacaacccgagacgtctgtatctggatttggacacagctatgaacgacaaacggccttgtgagcttcctccgagggcgacagtcgaacggcatgctgccacgtattgctcttcgtttgtctgcctcgtcttccccgtcttgagcaaatgtctgtttagcaggactctctgttcggcttaccagtcacacaactctcattctgctgcttcttctagagcttgtgtgtattcatttcttgccttgatatccatcttgaggtttgaggatggttccactgcaacaatggcgtgcgaatcatatgtggccgctgctacatcgatgataccccaggttatgcaagacatgacgggggatgggcttcaaacggtcgtcacaatggtatgtcctacatccatcaatagtacccctgatccctccaactctctaccttatgctagaattattgactatctcttcaatcgtcaagcatgttagaattgggttgtaatactcactaatggatgtgtactcgatcaacaggccatagtctattacttcctaggagatcttcagtccactggcctcttcatctccatcgctacacggctcatcttcgccctcaatgctcactccaatcccgactacaccactacaccgagatgtccttcgtcatcgacatccagccacggatcgccgacttcctcgcaactctacgataagagcaacctggctcatcatcttcgcgacctcttttggacctgctacgccattgacaaagacctatgcatccgtactggacagccttcttgtctcctagacctgcactgcgatcttacgctgcctcctgactactctgtgatgcagagccgtcacatccagagccctatcattccaggtctcggcaacaacactgtccccatgtacccctgggatctccgtctctctcagcttaagtcccgcgcatacgacgccctctattcgcccatggcccattgcaagacgcagtccgagctgctcgagagcatccgcactctcgacaagtccctcgagcagtggcgcttgtccattccgccggatatccgtccgacactcacgtttggtgaaacgacgcccgtgagcgcagacgtgagcatgcaatcgtccatgattcggctggcctactaccacttcgtcgcgatagtccatcgggctagtggaagatgcgagactcggtcaccggaaacgcaccacgaaggcgttcaatctagcttcaatatctctcttgacgcttgcaggtcgacggtcaggtatttgcgtgttgcccttcacgtcataacagacgattgcttctggtgagagccatcctttctccgtgtccacgcagccacccatcatggacaagaattgctaatggtctgtgattcgccccaggatcgtcatcttctatcccatcaccgccatcctcgccctcttctccaacatgatctctaatcctctcgacgagtcgaccgccggggacctcgagatcctcaaaagcgcccctacgctgtttagggatatcccaatacgaaagctaacaatggcggaattgacacatctcaagttcctagatgctttttcacaggagcctgccagactgggagagcttgccattcagaaagcaaggggttga

SEQ ID NO: 71 - protein, 612 aa, Trichoderma reesei QM6a
MMQAMAAGPPRSSNRGRRAKACDSCSRRKIQCDAEVPQCNWCRHHDLACTYSRLVGKPNKKRNRKRNSQPDSVTRMEAILTQRLSQHDDDAQTEYLDSFHPHLRNVTSFTGIPLFSERGRAWIESRTGSCMTPRTLCSFGRQWHNPRRLYLDLDTAMNDKRPCELPPRATVERHAATYCSSFVCLVFPVLSKCLFSRTLCSAYQSHNSHSAASSRACVYSFLALISILRFEDGSTATMACESYVAAATSMIPQVMQDMTGDGLQTVVTMAIVYYFLGDLQSTGLFISIATRLIFALNAHSNPDYTTTPRCPSSSTSSHGSPTSSQLYDKSNLAHHLRDLFWTCYAIDKDLCIRTGQPSCLLDLHCDLTLPPDYSVMQSRHIQSPIIPGLGNNTVPMYPWDLRLSQLKSRAYDALYSPMAHCKTQSELLESIRTLDKSLEQWRLSIPPDIRPTLTFGETTPVSADVSMQSSMIRLAYYHFVAIVHRASGRCETRSPETHHEGVQSSFNISLDACRSTVRYLRVALHVITDDCFWIVIFYPITAILALFSNMISNPLDESTAGDLEILKSAPTLFRDIPIRKLTMAELTHLKFLDAFSQEPARLGELAIQKARG

SEQ ID NO: 72 - DNA, 3429 bp, Trichoderma reesei QM6a
  CDS (1)..(2025)
  CDS (2110)..(3426)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49919.1 (76690)
  ref <309>: DATABASE ENTRY DATE: 2006-10-18
atgcccagctgcggcatcttctgcgtcgacaacggcatcaagtttctccccatcgtctctcttgatgtgcacacttccatcgttgcgtcaacctctcgcacagtcctcaggcagacgtttgcaaccaccggccgccccttcaggaacgtgcggtatgcctttcctctctatgatggctcatcggtcgtcgggttccaatgcaccatcggatcacgcaccatcaagggcgtcgtccaggagcgggacgaggccaagcaggcgtacaacgccgcagttgggcggggaaacacggctgctctgatggagcagtcgctggaggcttctgacgccttcgtcacctctctgggaaacatcccccgccgctgcgagagcgtcgatgttgaagtcacgtacctcggagagttgaagcatgatgcccaagtggatggactgcgcttcaccgtccccacgagcttggcccagcgatatggacagcattccatcaccggcagcgacgccattaccttccagggcggcaaacacatcaagatcacggtggacgtcgatgcctctagcggttcggtcatcaagaacatccagtcaccgtcgcacccaatcgctgtcagcattggcactctgtccacggccgcatctgatccgccatctctgcaaagggcccatgctactctggctcaggacgcggtcgtgctgggcagtgactttgtccttcaggttgtcgccaccggtcttggtgacccaatggctgttctcgaaaaccatcctacaatcccaaaccagagagcgctcatgacgacgctcgtcccaagattcaacctgccgatggagatggccgaggttgtcttcatgtgtgataggagcggtagcatggcagacggaaacaagatgggcaacgtcattgaagccctgaacatctttctgaaatctttgcccgtcggcgtcaagttcaacatctgcagcttcggctcgagctattcgttcttgtgggagaggtcaatgacctacgacgaggccaccttggatgctgccacacgccacgttgtcgggtttggggccgatcttggcggtacggaaatgttcaagccatttcaggagatattccagagacgctacaaagacttgaacctcgaggtgattctgctcaccgacggagggatctgggaccagaaagagctgttccagctcgttgatacccatgtggtcgagagcaagggagccatccgagtcttcgccttgggcgtgggaagagacgtcagccatgctctgattgaaggcgtcgcgcgagcgggcaatggcttctcccaggcagtggcagaagacgaaaagatggacaagatgctggtgaggatgctcaagggggcgcttactccgcatattaccgattattctctcgaaatcaagtatgggagcagggacgccgccccgtatggagagactgccgacgatgactttgtcgtcattgaaagagttatggactcactgacgttggacatctcaccctcctcggatacaacatcagagccccctccgcaacccatgtcactctttgaccaaagcgtccaggactcggacttggaaatacccacaagttccaactccgtgaccacgaagctcccgtccgtgacggttccgcaatatcttcaagctcccttccagataccgtcgcttttcccattcagccgcacgactgtctacgtcttgctttccgacgcaacgccagactgccagcccaagagcgtcatcctcaagggctcctccacttacgggccagttgaactggaaattcctgtcagggtcctcaccgaaaagggcactaccattcaccagctggcggcacgcaaggctgtccgcgaactcgaggacggccgcggatggatctttcacgccaaggacagagatggcaagctcttgcaagagcagtttgagggccagttcagcgatatggtgaaacaagaggcagtccgcctggggaagcaatatcaggttagcggcaggtggtgctcctttgttgccattcaagatgatgatgtggacgacgacgccaagatgaagcaacataagacagaggaggcagacgaaaacggagaaggcaatgctggtggtgacgacgaggacattccgtttgacgtgaccgcacaacaacaagcctcagctcgtggctccccgccgtcagcctcttgcaggatggggaagcgcaagcatgcgcaatccttcgaagcactcgaggttgagcccccttcgactcagcagccgcccatgttacaaggcgctggtcagccaaaaagtcaaattcgttaccttaccggcgttatacacaaccatcaaggcacgcttacgcaggttgctacgccagctaaccagtttcaagccatggcaatgcgggctaatataatagctgcccagcaggctgctcatcagcaggctattcgacagcaagctgttcaacagcagggtgctcaacagcgagctggccagggtcatggcatttctatgtcagcccctcaaggcgccaatatgatagctgcccagcaggctcaacagcaagccgcccagcaggctgctcagcagcgaaccttccagggccaagccatgcctacgtcggctaaccagatgacgcctcagatgttagctttcctgcaggctaaccagcaggctgcccatcaggctgcccagcaggctgcttaccagcctcaaggcatgtctggcggaccatatataagacagacggtcaggagaagcataacggtggtccaacagcaggcgtcctcaccagaagatgttcaacagcagcttgctgctgctgagcagataatacgccagcatcaagcaacagccgccgccggcgcaatgactgagatcaatggggcgaatgatgaccagacggccaatctccgagcaactctggctgcccagagagctgccgcggcccagcgcgctgcgagcttgcagctccatcaacagtatcagcactatcagcagatgcatgcgacgcagcagcagcagtatatgcagcaggggcctgctccgcttgtcctgaaccacccaatgggcgtggctcccgctcctggatacatcacctacccgactcccaatcccctctttggcggcgatggtaactctcccttactgaccctgactactctgcagaactttgctggcaattggcaatgggacgtgaggctggaagctgttttggggatcacagaggagcttgccgcggacagggttcagctgcctggtgatcagagtccgcaggagacggacgtgctggcaacgctctgcgtcgtggtgttcttgaagaagaagctggcgtctgaacaggaaacctgggagctccttgttcaaaaggcagaggattggctggagcgccaaaggggagcggatgtcttcgagtgggagaggattgtggaggatcagctctttacggaatag

SEQ ID NO: 73 - protein, 1114 aa, Trichoderma reesei QM6a
MPSCGIFCVDNGIKFLPIVSLDVHTSIVASTSRTVLRQTFATTGRPFRNVRYAFPLYDGSSVVGFQCTIGSRTIKGVVQERDEAKQAYNAAVGRGNTAALMEQSLEASDAFVTSLGNIPRRCESVDVEVTYLGELKHDAQVDGLRFTVPTSLAQRYGQHSITGSDAITFQGGKHIKITVDVDASSGSVIKNIQSPSHPIAVSIGTLSTAASDPPSLQRAHATLAQDAVVLGSDFVLQVVATGLGDPMAVLENHPTIPNQRALMTTLVPRFNLPMEMAEVVFMCDRSGSMADGNKMGNVIEALNIFLKSLPVGVKFNICSFGSSYSFLWERSMTYDEATLDAATRHVVGFGADLGGTEMFKPFQEIFQRRYKDLNLEVILLTDGGIWDQKELFQLVDTHVVESKGAIRVFALGVGRDVSHALIEGVARAGNGFSQAVAEDEKMDKMLVRMLKGALTPHITDYSLEIKYGSRDAAPYGETADDDFVVIERVMDSLTLDISPSSDTTSEPPPQPMSLFDQSVQDSDLEIPTSSNSVTTKLPSVTVPQYLQAPFQIPSLFPFSRTTVYVLLSDATPDCQPKSVILKGSSTYGPVELEIPVRVLTEKGTTIHQLAARKAVRELEDGRGWIFHAKDRDGKLLQEQFEGQFSDMVKQEAVRLGKQYQVSGRWCSFVAIQDDDDIPFDVTAQQQASARGSPPSASCRMGKRKHAQSFEALEVEPPSTQQPPMLQGAGQPKSQIRYLTGVIHNHQGTLTQVATPANQFQAMAMRANIIAAQQAAHQQAIRQQAVQQQGAQQRAGQGHGISMSAPQGANMIAAQQAQQQAAQQAAQQRTFQGQAMPTSANQMTPQMLAFLQANQQAAHQAAQQAAYQPQGMSGGPYIRQTVRRSITVVQQQASSPEDVQQQLAAAEQIIRQHQATAAAGAMTEINGANDDQTANLRATLAAQRAAAAQRAASLQLHQQYQHYQQMHATQQQQYMQQGPAPLVLNHPMGVAPAPGYITYPTPNPLFGGDGNSPLLTLTTLQNFAGNWQWDVRLEAVLGITEELAADRVQLPGDQSPQETDVLATLCVVVFLKKKLASEQETWELLVQKAEDWLERQRGADVFEWERIVEDQLFTE

SEQ ID NO: 74 - DNA, 404 bp, Trichoderma reesei QM6a
  CDS (1)..(203)
  CDS (248)..(401)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49924.1 (105894)
  ref <309>: DATABASE ENTRY DATE: 2006-10-18
atgaagtgtccttccccttcctccaaaccaggtatgctctccggccacttcgtcccctttgttgaccgatggacactgacgctcgcactcggacacagggcatctctccctcttcgcttcattctgctgccggtgggccggaccccacgaagccaaattcatctcggcccgccggcagctccagacaccaccaggagcatacggtatgtcgagtgtccattcctgatgatgctgcatgaactgacagcgatgacggcggcagcagcagcagcagcagcaacaacgacaacaagaacaacaccaacaccaacaccaacaccaacgccatcgccgtcaccatcgccgtcgccaccacacgagaaccaccacacgagaaccaccacatggcaacgcccttgacctga

SEQ ID NO: 75 - protein, 119 aa, Trichoderma reesei QM6a
MKCPSPSSKPGMLSGHFVPFVDRWTLTLALGHRASLPLRFILLPVGRTPRSQIHLGPPAAPDTTRSIRDDGGSSSSSSNNDNKNNTNTNTNTNAIAVTIAVATTREPPHENHHMATPLT

SEQ ID NO: 76 - DNA, 765 bp, Trichoderma reesei QM6a
  CDS (1)..(333)
  CDS (415)..(762)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49925.1 (59372)
  ref <309>: DATABASE ENTRY DATE: 2006-10-18
atgttaagtgtgcgcactgctcctctcacgttgcgccagtgcagtagatattgttctccctctttcgcccgtcgaacatttgcccaagccgtcaagatgtcgagcatttccgaggccatcaagaaggaccaccgcgagctggagcagtactacaatgaggtgatcaacaaccagggcgatcatgactaccaggagcggtacggcaaccagttcgtctgggagcttgctcgtcactctgtcggcgaggagctggttgtgtatcctgcgtttgaaaagtatctggggagcaagggcaaagaaatggccgagagtgatcgaaaggaccaccacgttgtgagtagcctgctgtaccactgcatactattattcgtcatgactacaagattactgatagtatgactcgaaccaaaacaggtcaaggaaatgctcaagaccttccaaaacctaaagccctcggatccagactacgtcagcaagctcaaggagctctgggcccctctctcggagcacatcaaggaggaggaggagcgagacctgccgaccctagaacagaagctccaggaggtggagggcgagtctgcgtccatggccaggtcctttggccgcaccaaggcctttgtgacctcgcgcagccatcccagcgccggcgagcacccgccatttgagactgccatgggcctgcttgctgcgccgattgatcatatcgcggatctgttcaggaagtttcccgataacacggtatctcccaacccttcgaccaaatag

SEQ ID NO: 77 - protein, 227 aa, Trichoderma reesei QM6a
MLSVRTAPLTLRQCSRYCSPSFARRTFAQAVKMSSISEAIKKDHRELEQYYNEVINNQGDHDYQERYGNQFVWELARHSVGEELVVYPAFEKYLGSKGKEMAESDRKDHHVVKEMLKTFQNLKPSDPDYVSKLKELWAPLSEHIKEEEERDLPTLEQKLQEVEGESASMARSFGRTKAFVTSRSHPSAGEHPPFETAMGLLAAPIDHIADLFRKFPDNTVSPNPSTK

SEQ ID NO: 78 - DNA, 1616 bp, Trichoderma reesei QM6a
  CDS (1)..(539)
  CDS (605)..(1261)
  CDS (1340)..(1613)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49942.1 (105924)
  ref <309>: DATABASE ENTRY DATE: 2006-10-18
atggctcccttgatttccaagaaggtgctgatgatcaccaacatcgagcgtggcgagatcaacaccttcctcgccacggctgcggccctcaaggctgccaacgtcgccttggacctgcatctcgccacctttgatggcgtccaagatgcactccccgagggcgtcacgtatcaccaaatcaatggcatctccatgtccgaggcccttcagaagcatttccttcgcacgcagggacatgccaacttcccggactccttcaccagggagcctggcttcgtgaatacccaacaggccataaaggacgccatgtcgacctctgtcccctacacgggaccccagatggtcgacgtcttcacctccatcgtgtccatcatcaaggacaccgagccagacttgatcgtcgttgatagcctcatggccgcgggcctgactgcctgctaccatgtgggcaccaagttcatctgccttggtccaacttccatcaagacattcgcagcctcctcgcagcctcgcgccgccggactctggaagtttccagcgtaagtgacatgagggagcgactcgtccttgcaagcgatgacatgagactgacgatgccgcccaggcccttctctggattctcgtaccctgtgcagtggcaccagatacccttgaatcttttctatgccttctctcaggttagggccctcaagaaggacaatcaaagaaaggatgttcaatcgtacctgaacgcccactgcgtcatcagaactcctgccgacctggttgacaaccgccccgagggcgtcaagatcctggtcagcagccttcccgagctggactatccgctcaaggtgcctgcccacatcatcccctgcggacctgtggttcgagcctacgctcccctctacaagaccaatccgaagctggccgaatggctcgccaacggacacacgatcctcgtcaacatgggagctctggtcaaggtctcggaggcgcaggcctttgagatggcgaaagccctcaagaccgtcattgatcgtttcgaccagaactccgagaagaagcggattcaggtgttgtggaagctccagaagaagggcagatactccatctatgcgcctgaatgcatcctcgcccacgtccttggcaaggagttcgcgtatgatcgcgtccgagtcgttgactggattcaacccgagcccctttccatcctccagactggagacgtcatttgctctgtccatcacggcggagcaggctcgttcaacgaggctgttgtgtaagtttgattctacttcctcatcatctatctatagggaaaaaatgtcagctgacgaacatctcttgtgaaatatagcaccggcgttccccaggtcgtcctgccagcttgggcggacaactacgactacgctcagcgtgttgagcttctcggcgtcggccgttgtggcaacaagaccaccaagcctcactggacttcgggagagctttctcgcgaaatgctcgacgttctcatgggtgacagcgcagcaatcatcaaggagaaggccatcattctgcagcatgcttgccaggagaagggcagcggcgctgagaatgcggcccttgctatcctgcatgagtgcagccttctctga

SEQ ID NO: 79 - protein, 490 aa, Trichoderma reesei QM6a
MAPLISKKVLMITNIERGEINTFLATAAALKAANVALDLHLATFDGVQDALPEGVTYHQINGISMSEALQKHFLRTQGHANFPDSFTREPGFVNTQQAIKDAMSTSVPYTGPQMVDVFTSIVSIIKDTEPDLIVVDSLMAAGLTACYHVGTKFICLGPTSIKTFAASSQPRAAGLWKFPAPFSGFSYPVQWHQIPLNLFYAFSQVRALKKDNQRKDVQSYLNAHCVIRTPADLVDNRPEGVKILVSSLPELDYPLKVPAHIIPCGPVVRAYAPLYKTNPKLAEWLANGHTILVNMGALVKVSEAQAFEMAKALKTVIDRFDQNSEKKRIQVLWKLQKKGRYSIYAPECILAHVLGKEFAYDRVRVVDWIQPEPLSILQTGDVICSVHHGGAGSFNEAVVTGVPQVVLPAWADNYDYAQRVELLGVGRCGNKTTKPHWTSGELSREMLDVLMGDSAAIIKEKAIILQHACQEKGSGAENAALAILHECSLL

SEQ ID NO: 80 - DNA, 966 bp, Trichoderma reesei QM6a
  CDS (1)..(42)
  CDS (120)..(446)
  CDS (510)..(608)
  CDS (673)..(963)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49943.1 (59368)
  ref <309>: DATABASE ENTRY DATE: 2006-10-18
atgaaggttctttgtcttcacggtgcctttggcagcgcttctgtgagtttggaaggatcaataaaacgttgaagagttttgctctcatacactaataatttgtcttgttacgtgctcagaacttcaaggttcagcttggcatcttcaccgatgctatcaagcagtcggacattgagttcaaatggatcaatggcttcacaaacgcaataccgccgcctggctttgacgactattttggcgctccacctctgtatcgattcatagacgttgatggcatgagcgagctggagcagatggtcgtcaagattagggacattcctcagggcgattccccagaagagacgatgaggaagctggttgccgacaaggagcagtttactaccccagctgtaactaaggcgttgagccagcttctgcagctcctggatgacgatccggagattgatgtgagatgaagttcagtcttgtgtgctatggagttccttgaccactgacacggctggacaaaggccatacttggttactcggaaggggctacagctgcagcgtctctgatcctcgaagagcagcgtctcttcaaggagcagggccgccctcgacacattaaggtaagatgccaaattgcctttgttcctgctgcgcttccctcgtcgtactgacaacatgcgcaagtgtgccatattctttgcgggctggccgcctgttcgcatcgccgacggtcgtgtcaagacgctgctcgcagacgagcacgacgagatgattgacattccgacgtgccatgttgtaggctgtaacgatccgtacattgatggcgcggtagcgctgtacgacatgtgtgatgaagatatggcaattttgttcgatcatgggaaaggacacacggtgccgcgggacgagacgacggtgggggagttggcaaagacgattgagaggacgtttgatcaagctgcattgtttgttcactag

SEQ ID NO: 81 - protein, 253 aa, Trichoderma reesei QM6a
MKVLCLHGAFGSASNFKVQLGIFTDAIKQSDIEFKWINGFTNAIPPPGFDDYFGAPPLYRFIDVDGMSELEQMVVKIRDIPQGDSPEETMRKLVADKEQFTTPAVTKALSQLLQLLDDDPEIDAILGYSEGATAAASLILEEQRLFKEQGRPRHIKCAIFFAGWPPVRIADGRVKTLLADEHDEMIDIPTCHVVGCNDPYIDGAVALYDMCDEDMAILFDHGKGHTVPRDETTVGELAKTIERTFDQAALFVH

SEQ ID NO: 82 - DNA, 2913 bp, Trichoderma reesei QM6a
  CDS (1)..(168)
  CDS (249)..(1440)
  CDS (1508)..(2910)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49944.1 (35726)
  ref <309>: DATABASE ENTRY DATE: 2006-10-18
atggtggcctacctccgtctgttgcccgtcttgggcctgcttctagcagatggcgcccgtgtggctgctcagggctcacacggcatagctcatggaaaggaggactggacaaagggggaatcgtccttcatcccaggtgcttacattgtcgagtttgaagacggccatgtgagttgtttctccaacatttcagacttttacctcgataaacccagcttgtcgagatctgaccccgtggtgaaatacaggaagaagcatcactgtttagcgacctccggcggcacggccttgctgcgaccaagcgactaaatctcaactataccctgtttaaaggagcgtcctttcagctggacgctgtcgacttggatcctcattccacttccgtcaggatcgcgactgttccctcggtgaagcaggtgtggcctgttcaacgatataagcgaccggccaatacaacactcagctcgacaagcagcgacccagatcacttgcccaatgtatcgaatctgcagcgcagagcagcatcggagaacgatacatatgcagttcatgctcaggttcaagttgataaactccatgcggagggaatcaccggcaagggcatcaggatcagcatcatcgacacaggagtcgacttcaaccaccctgctctgggcggctgctttggcaagggctgcgttgtcagctacggaagggacatggttggtgatgactacgacggcagtaacactcctgtgcctggtcccgagcccttgagcacctgcgacggccatggaacgcatgtcacgggcattatcggagccttgccaaaccccatgggcttcattggtgctgcccctgatgcgactattggcatgtacagggtctttggttgtagcggtgacgttggagccgatgttgccatctcagcagtcaaccaggctttcgaggatgggacagacatcatcaccctctctctcggcggagcgtccggctggacagaagaccccttctctgttgccgtgtcccggatcgtctcggcgggcgtcgtctgtaccgtggccaacggcaactcgggttctgcaggactgtttcttgccggaactccagcaaacggcaaaggcgtcactgcagtttcttcggtcgagagcactctgacgccatacctgggaacgggagccttcgtgagtacggataactcgacggcaaaccagaccctctttgtctatactcctggcgcttttccattccccaacaacatcactctccaagtatggccagtgacaccggaagtcaccacggatggcacttatggtgcttgcaatcctctcagtaacaaggccccggccgacctcagcgacaaggtcattctggtcaagtatgattctgcttgcagttcgtggacggaggtgagcaacctgcagaagaacaatgccacgtatttcatgttctggtataacagtcctgggaagtaagttttgccaacatctcactctctgatcattggacctggaaaaactaactacagtatctgatccaaccgacagtccttggtctatcggggctaccagtgcctctggtctcggaatgacaggctactcccaaggtgtccagtggctgaacgagctcagcagtggcaaggatctctggttgacgtttgtggagtcatcgtcatccaccaaggccggtgtctttgtgcccaatgccatcaatcccaactacattgacactttcaccagctggggcccgacgtggcaggctgatgtaaatccgtccatcagcactcccggcggcaccatcctgtctacgtggccgttgccctctggaggctactatattgatacgggaacttctatggccacgccggttatggccgctatctacgctctcgtcatgcaagctcgaggcatccgggacccgaaagctctcctcaacttggtatcgtcaacggccctgcagctacccttttatgatggggcaacgctgtatcccaccgagctggcttccgtagcgcagcagggcgcagggctggctcaagcattcaaggccgctcatacaacaacgctgctcaacgttcccaacattgcgttcaacgacacagacaactttgtcaagaagacgagcttcacgatccacaacactgggaagcaaagcgttacttacagcattggccaaacgcctgctctgaccatgtatacatatggcgatggcgacagtcactttcccgccccatttccgaatcccattgccgagggcgcctcagccaagctctccttttcgcacaacaagattacggtcgcggcaggtaagtcggcagatatcaccgtgacggccactcctcccaaaggactaaacgcctccgccctccccgtttacagcggatatgtcactgtcaacggcaccaacggcgatgggcttgtcgttccatacctgggagttgtcggcagcctggccaagctgccagtgctcgatcccgacttcaactacatgatccactacaacgtctactcgaccgttccggctgctgagaacacgacgtacgttgtgccctatcccatctcgacggccgcacagccaatcgaccctccaccggactatcccgcccccatcattcagatcgacgccggcacgcccctccttcgagccgatcttattgcactgggcgatacggctggcaaggtcaatacgaccaaggtgctgggcgtcgatatcgtcggcagtctgcctggctttccccttcccttcacttcgaggtcttacttcgttaccgcgttcacggggatgactcaggaggggatcattgtgcctgaggggagctacaagttcctgattcgggcggcgaagatatatggagatgtgagcaatccagacgactatgagagcatgctcactcagacgttcaacattcggtacaacaccactgccaccgcttga

SEQ ID NO: 83 - protein, 921 aa, Trichoderma reesei QM6a
MVAYLRLLPVLGLLLADGARVAAQGSHGIAHGKEDWTKGESSFIPGAYIVEFEDGHEEASLFSDLRRHGLAATKRLNLNYTLFKGASFQLDAVDLDPHSTSVRIATVPSVKQVWPVQRYKRPANTTLSSTSSDPDHLPNVSNLQRRAASENDTYAVHAQVQVDKLHAEGITGKGIRISIIDTGVDFNHPALGGCFGKGCVVSYGRDMVGDDYDGSNTPVPGPEPLSTCDGHGTHVTGIIGALPNPMGFIGAAPDATIGMYRVFGCSGDVGADVAISAVNQAFEDGTDIITLSLGGASGWTEDPFSVAVSRIVSAGVVCTVANGNSGSAGLFLAGTPANGKGVTAVSSVESTLTPYLGTGAFVSTDNSTANQTLFVYTPGAFPFPNNITLQVWPVTPEVTTDGTYGACNPLSNKAPADLSDKVILVKYDSACSSWTEVSNLQKNNATYFMFWYNISDPTDSPWSIGATSASGLGMTGYSQGVQWLNELSSGKDLWLTFVESSSSTKAGVFVPNAINPNYIDTFTSWGPTWQADVNPSISTPGGTILSTWPLPSGGYYIDTGTSMATPVMAAIYALVMQARGIRDPKALLNLVSSTALQLPFYDGATLYPTELASVAQQGAGLAQAFKAAHTTTLLNVPNIAFNDTDNFVKKTSFTIHNTGKQSVTYSIGQTPALTMYTYGDGDSHFPAPFPNPIAEGASAKLSFSHNKITVAAGKSADITVTATPPKGLNASALPVYSGYVTVNGTNGDGLVVPYLGVVGSLAKLPVLDPDFNYMIHYNVYSTVPAAENTTYVVPYPISTAAQPIDPPPDYPAPIIQIDAGTPLLRADLIALGDTAGKVNTTKVLGVDIVGSLPGFPLPFTSRSYFVTAFTGMTQEGIIVPEGSYKFLIRAAKIYGDVSNPDDYESMLTQTFNIRYNTTATA

SEQ ID NO: 84 - DNA, 2265 bp, Trichoderma reesei QM6a
  CDS (1)..(40)
  CDS (98)..(573)
  CDS (727)..(2262)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49754.1 (105931)
  ref <309>: DATABASE ENTRY DATE: 2006-10-18
atgcgatttctcgtggtaatcacgagcttggctgccctgggtatgtgataaatgcagaaatgaagcaagttggaatcgtctctaatctcgtagttagcacgcgcccagctgctgggaataccgaccgtgccattcgacatctcctctgaccaaaccttcgacttgagcaaggtccacgccgttgttgtcgacatcgcccactcgtcaacccgcaatgaagatggcctcaccttgattcctcctaccctgtgggggtttgcagagacatttcgaaacgatctggccggcatcggaatcaacaccgtcttgctccctggatccaacgccattagagattccatctacctcacgctggaccacgacaaggcacagtttctcaacgccgcgggaaataagacttcagagggctatcgtcttaccgtgacttctacaggcgtgactgtcagcggtgccagcccccttggagcttggtgggggacgcgaacaatcttgcagcaggcgttgatcaacgacaagaagctcaagctggggacgggaatcgactctcctggatggtcagagagaggcatgatggtaagcaacgatatgggagcgaaggtctcattttggactctccacagctaatcaatgtctttcccgttcgctttccggaagctcgacgttggacgccactattacccagccgaatttctcgcagaaatgtgctcctacctctcgttcttcaagcaaaacgtcttccatcttcacctcagcgaccacgtctgggaccccgccaagctcggctctcacgagctcgccctccagctctacgcggcgtttcgagtcggttctgccgacccagaagttgctggcctcgcccgccccgtcaacgagacatacagcccgtccgagttcgacaagctgcagcaaagttgtgctcgtcgtggcgtgaccatcctgcctgagctcgagtcgccgggacactccatggcgacgaccgactggaggcccgagattgcgctcgccgactttagcatgctcaacctgagccatccggagacgcttcccacggtcaagtcgtactggaaggccgtcatcaacaacttccactccaaggttgtccatataggggcagacgaatacgacagcaacttcatcaacgagtacagcacgtttgtcaacgagatgagcgcctacatccggtccatctctgggaagagcactcgcatctggggcacgttcccgccctcgtcagcccctggcgccgtcaatgttgacaaggacgtaacgatccagcattggcagattggccaggacaatggcctctttgactttatcgacaagggatatagtatcgtcaacagcgacgactacttttacctcgatctcaagtattccgatggcaacgtgtaccccaaggagctcgatatccagcgtgtctttcatggcgcccccgacggcagtgcgtttgcacccaatatcctagacaatgccaacgcgacgaacaaccctcctcgagatagccccaacgtgctcggccacctggctgtagtatggaacgactggggccccaatgcgagcacctaccacgaggcctactacatggtccgcaacggcttgccagctctggctgacaagcaatggggtggctcgctgcaggagaaggactacgccagcctattcgcgactctgcagccagcggtgccagaccagaacctcgaccagcgaattccctccaagggctcgaccattgtatcgtacagcttcggccgcggtagcctcttgtcggcggttgctgtcctcgatggctctggaaacaactatcacgggcatctcaaaaacggcgcgtatgtgagcggcggtgctctgcagctcaatggccgaggagcccatctcaggactcctctgacaagcaagggacgcaactacacgctttccttctcggtgcttcccaaggctcatggtggaacgctcttctctggcccggacagcagctttctcaacggcaacggcacgtcgaccaaacttatgctcgtgtcccataacattgcgtatccagtcaacctgacgttgcctctcaatgaatggagcgacgtcacggttcaaggcatcggtccgcagacgtttatttctgtgggcaagcagcgccaggaggtgacgatcctgatgggcatttggggaggatacatgcaggagggaccgatggcgattgaggcgccgattcagacgattggacagggctttaatggacagatgaaggatatcaagctctcaagtgaagtataa

SEQ ID NO: 85 - protein, 684 aa, Trichoderma reesei QM6a
MRFLVVITSLAALARAQLLGIPTVPFDISSDQTFDLSKVHAVVVDIAHSSTRNEDGLTLIPPTLWGFAETFRNDLAGIGINTVLLPGSNAIRDSIYLTLDHDKAQFLNAAGNKTSEGYRLTVTSTGVTVSGASPLGAWWGTRTILQQALINDKKLKLGTGIDSPGWSERGMMQNVFHLHLSDHVWDPAKLGSHELALQLYAAFRVGSADPEVAGLARPVNETYSPSEFDKLQQSCARRGVTILPELESPGHSMATTDWRPEIALADFSMLNLSHPETLPTVKSYWKAVINNFHSKVVHIGADEYDSNFINEYSTFVNEMSAYIRSISGKSTRIWGTFPPSSAPGAVNVDKDVTIQHWQIGQDNGLFDFIDKGYSIVNSDDYFYLDLKYSDGNVYPKELDIQRVFHGAPDGSAFAPNILDNANATNNPPRDSPNVLGHLAVVWNDWGPNASTYHEAYYMVRNGLPALADKQWGGSLQEKDYASLFATLQPAVPDQNLDQRIPSKGSTIVSYSFGRGSLLSAVAVLDGSGNNYHGHLKNGAYVSGGALQLNGRGAHLRTPLTSKGRNYTLSFSVLPKAHGGTLFSGPDSSFLNGNGTSTKLMLVSHNIAYPVNLTLPLNEWSDVTVQGIGPQTFISVGKQRQEVTILMGIWGGYMQEGPMAIEAPIQTIGQGFNGQMKDIKLSSEV

SEQ ID NO: 86 - DNA, 634 bp, Trichoderma reesei QM6a
  CDS (1)..(9)
  CDS (89)..(631)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49756.1 (3310)
  ref <309>: DATABASE ENTRY DATE: 2006-10-18
atgcctccagtacgtattcttccagaagtctcactgactctctcgcaccttcagcccagcgtcaccaactaacgcgtcgtccttccagagacaccaaaccctccctcccgcgcaaacgacctcggcgaaagaggcccagaaatccttctactgcaccctctgctccaagggctactcccgcatgaacgactatgaagcccacctcagcagctatgaccacagccacaagcagcggctcaaggacatgaaggccatggtgcgcgatcccaacgccggcgcaaaggcgaggagggccgaggccaaggcggacggcatagtcagcatcaagctcaccgagcaggatgcgccgtcgtccggcggcggaggcggcggcttcaaaaagggcggcttcaagaagactggcttcaagagcgctttcgccccagtagacgcaccgacatcagccgccgctaccgcatcgcagccagcgtcgacagacttgccccggaaacaagcgaatcctgctgctggtgctctcgcagacaaggggaagactgctccgtcttcctcgcgcatctacaagggttcactcgtggagagcgatacggaagatgaaggctacgaagtctacgatccgaggttccccaccgattga

SEQ ID NO: 87 - protein, 184 aa, Trichoderma reesei QM6a
MPPRHQTLPPAQTTSAKEAQKSFYCTLCSKGYSRMNDYEAHLSSYDHSHKQRLKDMKAMVRDPNAGAKARRAEAKADGIVSIKLTEQDAPSSGGGGGGFKKGGFKKTGFKSAFAPVDAPTSAAATASQPASTDLPRKQANPAAGALADKGKTAPSSSRIYKGSLVESDTEDEGYEVYDPRFPTD

SEQ ID NO: 88 - DNA, 1766 bp, Trichoderma reesei QM6a
  CDS (1)..(1249)
  CDS (1372)..(1763)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49958.1 (76758)
  ref <309>: DATABASE ENTRY DATE: 2006-10-18
atgtcgccggcccatgtctcggcccccgtgcccagcaaggtcgacatttcgacggctcaggaggctgcggcagccactgacgccgaacacaacatgggctttgtcaagtccttcaagctatattggaaagcttgtttgtggtccatcttcatctcgacatgcatcatcatggacggcttcgacacggcgctgctgcgatcgctcttcgcctacccggcctttcaacgccaatttggggttcagcaggccgacggaagctaccagctcacggctgcttggcagtcgggcctcaccaatggagtgctctgcggctccatcatcggactcttcatgaacggaatccttgccgaccgcttcggatatcgcaagaccctcatcggcgcgctggttggaatcacgggcttcatcttcatcatcttcttttcgaaaacgctgccccagctccttgttggagagattttggcaggcattccctggggcatcttccagacgctcaccacgacgtatgcctctgaagtgtgccctacccacctccgagcctacctgacgacctacaacaacctctgttgggtcatcggccagttcatcgcgtcaggcgtgctccgcgccatggtgtccagaactgacgactggggctacaagatcccattcgcgctgcagtggatgtggccggtgcccctagcagttggcatctatctcgcgccggagtctccctggtggctcgtccgacgcggaaaggtggatgaagccagacgctctttggctcgtctgacgagccgcagcaccgcaggcaccgagttcaacattgacgaaacgatatccctcatgatccataccaacgagatggagagggagctgactgccggcacgacgtactgggacctcttcacgggcgtcaatgctcgccgcactgaaattgtgtgcatggtgtggatgggccagactctgtccgggtccaacttcatggggtactcgacgtatttctaccagcaggccgggttggctgtcggcagctccttcagcatgtccctcgggcagtacggcattggcattgtcgggaccattctgtcttggttcttgatgacctggttcggtcgtagaacgttgttcttcactggccaggtgtgtgcgtgcctcatcctcttcaccattggctgcgcgtcctttgcaggctcagccaataccagcgcgcaatggggcatcgggtccttgctgcttgtgtatacgtttgtgtatgattcctctgttggtacgtctctctgcctcccacccctgccccgtctcccccccttctcctctcactcttttccatcttgtccccatattactgcgtattgggcagaattcgagttagtgacacgcatcgcccaggccccatctgctactcgcttgtcgccgagctcacgtcgactcgtctgcgagcaaagtcggtcgtgctggcccgcaacatgtacaacattgccagcatcatcgccaacatcctgacgccgcgcatgctcaaccccaccgcatggggctggggtgcaaagacgggcttcttctgggcgggcactgccttgtgctgtgcgacatggaccttcttccgccttccggagccaaagggcaggacatacggtgagcttgataccttgtttgagcagggagtgagcgcgcgcaagtttgccaccacggctgtggggaggattgatgccggctttgagtctgtttcgattagaaaggatggaggttccactgccgagattgagcgtatcgcacccaaggcgtga

SEQ ID NO: 89 - protein, 547 aa, Trichoderma reesei QM6a
MSPAHVSAPVPSKVDISTAQEAAAATDAEHNMGFVKSFKLYWKACLWSIFISTCIIMDGFDTALLRSLFAYPAFQRQFGVQQADGSYQLTAAWQSGLTNGVLCGSIIGLFMNGILADRFGYRKTLIGALVGITGFIFIIFFSKTLPQLLVGEILAGIPWGIFQTLTTTYASEVCPTHLRAYLTTYNNLCWVIGQFIASGVLRAMVSRTDDWGYKIPFALQWMWPVPLAVGIYLAPESPWWLVRRGKVDEARRSLARLTSRSTAGTEFNIDETISLMIHTNEMERELTAGTTYWDLFTGVNARRTEIVCMVWMGQTLSGSNFMGYSTYFYQQAGLAVGSSFSMSLGQYGIGIVGTILSWFLMTWFGRRTLFFTGQVCACLILFTIGCASFAGSANTSAQWGIGSLLLVYTFVYDSSVGPICYSLVAELTSTRLRAKSVVLARNMYNIASIIANILTPRMLNPTAWGWGAKTGFFWAGTALCCATWTFFRLPEPKGRTYGELDTLFEQGVSARKFATTAVGRIDAGFESVSIRKDGGSTAEIERIAPKA

SEQ ID NO: 90 - DNA, 1797 bp, Trichoderma reesei QM6a
  CDS (1)..(1794)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49768.1 (59578)
  ref <309>: DATABASE ENTRY DATE: 2006-10-18
atgactgttcctggacgccccaagctgtggtggaagcatgctgtcatctaccaaatctacccagcatcattttgcgactccaatggagacggaatcggagaccttccaggcatcatctccaagcttgactacatagctcgcctcggagttgatgtcgtctggatctgccctatgtacgacagccctcaggtggacatgggctacgacatctccaactatgaggatatataccctccctacggcaccctgcaggacatggagactcttattcgcgaggctcatgttcggggcatgaaagtcatgctagatcttgtcatcaaccatacatctgaccagcatccctggttcgaggaatctcgtgcgagcaaagacagctccaagcgcgactggtacatctggcggcccgccaagctttctcccactggagagcgtcttccccccaacaactggcgttgcaagtttggcggcggcagcgtgtgggagtgggacgagcagtcgggcgagtactatctgcacttgttcgccaaagagcaaccggacctgaactgggagaatcccatcactcgcaaagcggtctatgcctcggcgatggaattttggcttgagcgcggcgtggacggctttcgcatcgacaccgtcaacatgtatagcaagccgccagggctcccagatgcaccagagctggaccccggagctccatatcaggcggctgacatgctgtactgcaacggccccaggatgcacgaattcctcagcgagatgaatcagatcatggccaagtacggcgctatctcggtcggggaacttccatcgacgcccgacatggcccgcgtgctgcaatatgtgagcgcagaagccaagcagctggacatggtgtttcagtttgacgtcgtcaatgttgggttcaacaagccgctgaggtacgatgcggagccaaaggactggcaattgcccgaattcaaggaggccatcgctcgtacccaaactctgatcaagggcactgatgcttggacgacggtctttctggagaatcacgaccaagcgagatcaattacacgctttgcagacgatagccaacagtttcgagttgcaagcggcaagatgctggctcttctgcaggcatgcctaagtggcacgcagtttatatatcaggggcaggaaattggagccatcaacgtgccacaagacggttatccgcttgacaactacattgacgtgagcagccgcttgtatctcgactttgtccgagagcaccgcaacggccaaggcatggacaaggccctcgcttctctggcacattttgcacgggaccatgctcgcgtccccatggtttggaacgggaaggccaagtacggcggcttctccgaggaggcagaaaagtctggaaaggaggtcaaggagccctggatgaaacctcatcccttgggagggcagattgacgttgcttcgcagctcgacgacccgcacagcgtcttgacctactggcaaaaggccgtgctcttccgaaagcagtatgccgatctgctcgtatacggcgactaccggaccctgcgagaggaggacagggagacttacacctttataaaggagccgccgtctggtggatcggccaaggccgtcgttgcgctcaactttactggcgaggagaagaagtgggagaagccaacggccgcagaacttgccgttgaggatggcgccgcgatcagtttcgttcccatcatgtcttcctacgatggcaaagtcgatgagggagccttgaagccctacgagggacgagtctatctggtcagctggtga

SEQ ID NO: 91 - protein, 598 aa, Trichoderma reesei QM6a
MTVPGRPKLWWKHAVIYQIYPASFCDSNGDGIGDLPGIISKLDYIARLGVDVVWICPMYDSPQVDMGYDISNYEDIYPPYGTLQDMETLIREAHVRGMKVMLDLVINHTSDQHPWFEESRASKDSSKRDWYIWRPAKLSPTGERLPPNNWRCKFGGGSVWEWDEQSGEYYLHLFAKEQPDLNWENPITRKAVYASAMEFWLERGVDGFRIDTVNMYSKPPGLPDAPELDPGAPYQAADMLYCNGPRMHEFLSEMNQIMAKYGAISVGELPSTPDMARVLQYVSAEAKQLDMVFQFDVVNVGFNKPLRYDAEPKDWQLPEFKEAIARTQTLIKGTDAWTTVFLENHDQARSITRFADDSQQFRVASGKMLALLQACLSGTQFIYQGQEIGAINVPQDGYPLDNYIDVSSRLYLDFVREHRNGQGMDKALASLAHFARDHARVPMVWNGKAKYGGFSEEAEKSGKEVKEPWMKPHPLGGQIDVASQLDDPHSVLTYWQKAVLFRKQYADLLVYGDYRTLREEDRETYTFIKEPPSGGSAKAVVALNFTGEEKKWEKPTAAELAVEDGAAISFVPIMSSYDGKVDEGALKPYEGRVYLVSW

SEQ ID NO: 92 - DNA, 2811 bp, Trichoderma reesei QM6a
  CDS (1)..(2808)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49993.1 (59751)
  ref <309>: DATABASE ENTRY DATE: 2006-10-18
atggcttcaacccattccacgggcggacagtccgctgctgcttccaaaaagcgcggccccccagctcacaacgcccgcagcgatgcgttcatgcagaagcgcgccaaggtgcatgctgcgcgaagcatcccgacgcaagctgccgatgccgcgctcaaggatggcgagctggacctggtggcctttgtagcggcgcacgagtttgagattcgtgccttggagcagagcatggccacgaccaaagcagtcaagagcagcagggccttccagcaggtccctcgcgggttgagacggcgcacggcgagccacaaccccaagcgggtgccgcgaaggcttcgggccagggccaggaaagagatggacgaagacaacacgcccctagtcgaatcacgaaaacgaaagccgaggacgacgagagcgaggatacgagcccagacggccaagcgactgcgcatactctcagcgcgcaagaagaagaggaagcagaagaggagccagcagccctccgacaacgagaagcaacacgacccgaaagcgtctgcgacaacgggcgtcaccgacgtggcaagggctcccaagcccaagatacggaggaacgcgctcaacgaaccacccagaccggccgcaaagttcagaaggaggcagatgaacaaaacctggctgcccacacatcaatggcacgcaaagcgggctcgcatgacggagcccacggagcccctgtggcgctttgccatcccgctgacacccaatgaaaagatatatcgaccgacgcacagggcgcaaggagaacgcgggacaatggtctgggacatgacatatatgagtaccattggcctctatggaaactttgccggcatggcgcgagtcctccaaagggtcggagtgacgaatgattcttgctgggacgacagaggagcaaagtggaggcagggtacccgagcgtggactggcatcttgagcagggagagagccggaattcggcggccaatatgccaatcgatagttatctgggatcctgaggcagcgccacaacacatcgacgaagatggcgcagggagggaaggagagcagcgaggcgcaatcgacaagaagatgcagagacgcgtctttctcagagtccatccttcggcttttctggagctattcaatgagctactgcggctgatcaagatggaaaagcccaggctgtacattgaagatttgaggttcgaaatcggaagcatagagctctctggtcccgcgtctaccgaggttctactgtcagtcttgacgccgtatccttccggggattcaagtccgaagaacaagcatgccgaactgttcgagtctctgaaagggctaacaaacccggcggccctaccgagtaattcagtgctacactttgcagtccaggatcctcggctgaggtatccgccacggaagatggagttccccgagaacgagcaggctcagatggatttgctggcaacgatcgccagctggcccgcggaagatagcttgcagccgtcgctgctattcgaccgacatgcccgtcatagggcctcttgcttgccatcacaaaagtccatcaacaggagaagaagtaaggtcacatccggagcgctcctgaagccaaccatccacgatcccccaatccccgtcacgctcatcgcgtctcgttccgcgccaggcgcgcaggcgcaagggacatggactctgctggctccctggaaatgcatactccctctgtggtacagcatcgttcactgcccgcttgtctcgggcggcaacccacggtttgccggtctcaacgagacgatgcaagtggcctttgaacgcagtatcccatggttccctgccgacttcctaggtactgacgcaggagctgaatgggaacttgagcgcaggcagaggcgaaagagggattgggcacggcgccccaaaagcaagagggtcgaatggacgtctctatcgctgggcgcaggccgacagggcgagattggagacggccacgcctgcgactttgaattcctctttggccttgcggcgcagcagcagcagccgagtgcaccgcccgacgatgcaggggaggcaatggacgttgatgaggaaactttgacgccgaccaaggagaagttgaaagacgtcgcgataccacgcctcaagcttttgaacagcatccccaaaccagacttcaacagcctgctttcgccatcctcgcctcttcagccgcttcctccaaacgccattgcgtgcgtccggatatcgctcctctcgcgaggcgttgtcggtccatgcgcgaggatataccgtctaccttcagtccccatcccaataccgccgtcatccgatgccgaagttcccgcaagcatgcccccagaggctttgtctcttccgtccgatcttcgttcgcagtggctttcacgcatccccttgtcttcgtcctctcccacctggtccaagtccaggtcatctctagcttcccagactcattcaaagagggcagcgtcgcgtttagacgacctggagacgcgcaaacgcattctagcgcaggagctcctcaatgctccttcaactctggaaagcggctcgggggccaacgaggcggatattggcggacaccatccgctggtgcctgatgcaaaggacctcattggctttgtcaccacggggtctttctgtctggcgaatggtcgaggggcggcgattggcagcatcgccgtagagaaggtgttggcagaagtccgcgcgaaccccaaggaggggaggctgtgcattgtgagaaacgccggcgagaatgttggctggatcgcaaggtgggaggcggtttga

SEQ ID NO: 93 - protein, 936 aa, Trichoderma reesei QM6a
MASTHSTGGQSAAASKKRGPPAHNARSDAFMQKRAKVHAARSIPTQAADAALKDGELDLVAFVAAHEFEIRALEQSMATTKAVKSSRAFQQVPRGLRRRTASHNPKRVPRRLRARARKEMDEDNTPLVESRKRKPRTTRARIRAQTAKRLRILSARKKKRKQKRSQQPSDNEKQHDPKASATTGVTDVARAPKPKIRRNALNEPPRPAAKFRRRQMNKTWLPTHQWHAKRARMTEPTEPLWRFAIPLTPNEKIYRPTHRAQGERGTMVWDMTYMSTIGLYGNFAGMARVLQRVGVTNDSCWDDRGAKWRQGTRAWTGILSRERAGIRRPICQSIVIWDPEAAPQHIDEDGAGREGEQRGAIDKKMQRRVFLRVHPSAFLELFNELLRLIKMEKPRLYIEDLRFEIGSIELSGPASTEVLLSVLTPYPSGDSSPKNKHAELFESLKGLTNPAALPSNSVLHFAVQDPRLRYPPRKMEFPENEQAQMDLLATIASWPAEDSLQPSLLFDRHARHRASCLPSQKSINRRRSKVTSGALLKPTIHDPPIPVTLIASRSAPGAQAQGTWTLLAPWKCILPLWYSIVHCPLVSGGNPRFAGLNETMQVAFERSIPWFPADFLGTDAGAEWELERRQRRKRDWARRPKSKRVEWTSLSLGAGRQGEIGDGHACDFEFLFGLAAQQQQPSAPPDDAGEAMDVDEETLTPTKEKLKDVAIPRLKLLNSIPKPDFNSLLSPSSPLQPLPPNAIACVRISLLSRGVVGPCARIYRLPSVPIPIPPSSDAEVPASMPPEALSLPSDLRSQWLSRIPLSSSSPTWSKSRSSLASQTHSKRAASRLDDLETRKRILAQELLNAPSTLESGSGANEADIGGHHPLVPDAKDLIGFVTTGSFCLANGRGAAIGSIAVEKVLAEVRANPKEGRLCIVRNAGENVGWIARWEAV

SEQ ID NO: 94 - DNA, 1567 bp, Trichoderma reesei QM6a
  CDS (1)..(204)
  CDS (245)..(365)
  CDS (456)..(1143)
  CDS (1213)..(1564)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49812.1 (27992)
  ref <309>: DATABASE ENTRY DATE: 2006-10-18
atgcttcggagatcatcgctcattcttatagcggtcgttgttgcagcgtccgccaccgccgttatacctcccggttcgaggcagcagcattatgccaacatatctaatgtgtcgagctcttatgtggcgtcacctatccatccgatccacctcccgttttgcgctgtaagttcatgccaatccatgtcttttgactcccatcaagttgcgattacggaagcaagctaacttggcaatctgaaagcttgattgcttcacggccaattgttcagagctcgatctatcatgcatctgcaggagcttgaatcagccgtcacaaagcttgtcgtgcttcaaagcatcatgcagcctttccgaaagcctgggtatgggagccaatctgtcattctgtttctgtttcttcttggccgttgtatcgttgcatgctttgcagtggggctaacatcacgttctagtcatgatgaatctcacccaaacagtgtgtggtggctcagtgcgagatcgatcaggtcgttacaagacgatgaacattgctcttagctctgtaacccttttgatcgccggcatgcgcttcgtgtccaagtttctcttcagcatcagacagggttttggtccggatgattggaccatgttggcagcaggactaatcggtataccatgcatcattttcaacatctctgggttgagtgaccacggactaggcaaagatgtttggacattgcctccaggagctttggcttcattcgcacaatggtttctggccatggaaatcctctacgtggtcatcatatcgattgtcaaatccagcctgtcgcttttctatctcgatttgtttccaggaactacttttcgccgagtcatctgggccaccatcatattccatgtcacctccggcctcagtttcgttgtcggcagcctcttgcaatgcgtacccctgagtctcgcgtgggagcaatttggcgacggcaccaatcgcccaccaggacactgcatcaacgtgaatgctttagcgtgggtcaacgccgccatgaatattgcggtcgacatttggctcatagggattcccctataccagctgtacaagctagacactcagtggaggagaaggttgagtgcggccgttatgttcatgacaggagcaatgtgcgactgctcccccctttcctgacaaacaaaggactcatacactaacttctcgccatgacggagtagagctaccattgtctccatcctccggctgcagtctctcgtccactttgctaattcgacgaaccccacgtgggaccattggaatatcgcctggtggtctaccattgaagtcaacataagcatcatatgcacatgcctcccatccatccggctgattttggcacacttatgtccacgaatggttggttcgagtctcggcctatctccgatatccgaggactcttggatcggtgagaagatcaccagtccaaatcctttggatatcgaacgcctggagctgtgcagcaatcggagcaaagacgggggatcaaagaccagcaaatctacacagagagtggaaggggtacggggcatctaa

SEQ ID NO: 95 - protein, 455 aa, Trichoderma reesei QM6a
MLRRSSLILIAVVVAASATAVIPPGSRQQHYANISNVSSSYVASPIHPIHLPFCAVSSCQSMSFDSHQLDCFTANCSELDLSCICRSLNQPSQSLSCFKASCSLSESLVMMNLTQTVCGGSVRDRSGRYKTMNIALSSVTLLIAGMRFVSKFLFSIRQGFGPDDWTMLAAGLIGIPCIIFNISGLSDHGLGKDVWTLPPGALASFAQWFLAMEILYVVIISIVKSSLSLFYLDLFPGTTFRRVIWATIIFHVTSGLSFVVGSLLQCVPLSLAWEQFGDGTNRPPGHCINVNALAWVNAAMNIAVDIWLIGIPLYQLYKLDTQWRRRLSAAVMFMTGAIATIVSILRLQSLVHFANSTNPTWDHWNIAWWSTIEVNISIICTCLPSIRLILAHLCPRMVGSSLGLSPISEDSWIGEKITSPNPLDIERLELCSNRSKDGGSKTSKSTQRVEGVRGI

SEQ ID NO: 96 - DNA, 1949 bp, Trichoderma reesei QM6a
  CDS (1)..(11)
  CDS (77)..(188)
  CDS (254)..(415)
  CDS (756)..(841)
  CDS (908)..(1089)
  CDS (1144)..(1302)
  CDS (1376)..(1469)
  CDS (1550)..(1946)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49814.1 (59381)
  ref <309>: DATABASE ENTRY DATE: 2006-10-18
atggacgcagagtacgagaccctccggagcaacagccccgagcatcctaggacgaccgctgacacttcctgtctagagacggaactgttcccctcgacgagacatatgcggagactgtcaactatcacggccgagtcttccagcagcatgccttggacagcaagatatattatgcgccgatcgatgatgtatgttgttcgttgcagatgcaccattccaccgctggcacccgtctcttaacacggcgaatcaggaagaaatagcgcgattggggaacatgcacactatgcttcgcacggttttcgacaacagattgatatttcctcccgttgtcaggccgcagaggatcctcgagtgcggatttggggcagcacactgggccgtcgatgttgctgaacactatccagatgcagaggtgcgtgcttagctctgttatgcttaaacaatcctcgtcggccgacgagcgggccaacggcgggcccattggctcatggtgggaatgggagtgaggatgaagagaaggataccccaaagcatttttctggaagaggtttttctcttcttacccccccttgggtggcgggctcttgtttgggtggcgtgtaacgtcgaaagctctgtcagaagggtgactgggcgatgacggtcctgagcgcccggcgacgacaggttgccaacagtccgcctatcatcctccacatctctctgcatgagattattgcgtcgatgagggaagtatgctaacagactcacaggttgttggtttagatatcagtccgcacatgattcccgaggagatgccccacaatctcgaccttcaagttgatgatctgaatggagagtgagttactgaagattttgctcaataacagagagagtctcgtctgaccatgtcgtcatggcctaggttcacgtttccctccaactatttcaatgtcgttcacagccagatgatggctggagggatccacgcgacccgttggccaagctatttgcaagacatgtaccgcgttctgctgccaggtggttggtgtcaacttgttgagatatatttcaatgctcagtcagacaatggaactctgtcaccaggtaagttgacctgtttgggcgcttcaacgcgatggtgtttggttaacgacgtagatcacgcactttcgagatggtctcgcggatacctcgacgccctacatcctcaaaaggacccacgggcagctcttcgcctcaaagattggatgagaaacgccggcttcactgacatagagtcgcgccttttgactctgccaatgtgtccctggccaaccggtatgtcattgaaacgaaacttgagctgccatcagattgcttgggagctcccctctgacacttctggattcagatccccgtgatcatgcgattggtgccctaaacgtcagcaatgtcagtcaactgctttattcgatgggcctgtatcccttcacgcatattcgagggtacgtctcgctgatcaagccattgatgtttaccgggagggaatgaccatgctgacatggctcggcggcgggaactccagtatgcctctggaggacttccagctcctggtagctcaagctagaagcgaggccaccaattcgtcgtatagggtgagcaaagccaacactagctgtttcaagtcaaaagtaatctggctaaccgaaggtcggcgatccaactgcagacctacttccctctgtaagtcaaaatcaaacgatttcggagagcctgggggttgggacaatggcgacttaccaaggacaaccgcagatatgtcttcattggacggaagccgcaccaataatggagtgactcgagctgcggccgcactgtgcaattggcaattgaagagacgatgcagagcctgcctcgagggcttgaaggcggattgtttgaatcgggggcagacagagctatcgtgggaagggttccaaagctag

SEQ ID NO: 97 - protein, 401 aa, Trichoderma reesei QM6a
MDAEDGTVPLDETYAETVNYHGRVFQQHALDSKIYYAPIDDEEIARLGNMHTMLRTVFDNRLIFPPVVRPQRILECGFGAAHWAVDVAEHYPDAEVVGLDISPHMIPEEMPHNLDLQVDDLNGEFTFPSNYFNVVHSQMMAGGIHATRWPSYLQDMYRVLLPGGWCQLVEIYFNAQSDNGTLSPDHALSRWSRGYLDALHPQKDPRAALRLKDWMRNAGFTDIESRLLTLPMCPWPTDPRDHAIGALNVSNVSQLLYSMGLYPFTHIRGMPLEDFQLLVAQARSEATNSSYRVSKANTSCFKSKVIWLTEGRRSNCRPTSLCKSKSNDFGEPGGWDNGDLPRTTADMSSLDGSRTNNGVTRAAAALCNWQLKRRCRACLEGLKADCLNRGQTELSWEGFQS

SEQ ID NO: 98 - DNA, 1068 bp, Trichoderma reesei QM6a
  CDS (1)..(146)
  CDS (225)..(1065)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49998.1 (3363)
  ref <309>: DATABASE ENTRY DATE: 2006-10-18
atgacgacaacgtttctttccggggctgcctttggtgcagctatgatggcggcttcctttcacaaccctgccatagtcatcgctcagatgaagtttgaaaattggcacatgatgcaggcgtttctcgccgcaactgcaagcagcgcgtaagtccttccacacgactgcaggatatcgtctccaggaggctccatgtctgcaaagctgaccattgatgaacaaagagccatgtatgccgttgcagatcgcctcgactacgtcaaattgaagcccagaagttcgtctccgttagctctcttctccaaatatgacggcaacatcatcggtggcgcgctcctcggtaccggcatggcgttgtcagggtcctgcccgggaacgctgtacgctcaactggctgctggcgtacataccggctttcatgccctcaacggagccatacttggcggactcttgtggacgggactcctgtccaaggtcgtcaagcaaaggaaagaaaaagcaaaggccgaccccattacagtgactgccaacgatcaacttgggttgagcagaggcgtcacattgcttctcttcgaggctgtgtgcctttcggtcctcgcagtgacgacattctacacccccaaattccccggggccaagatggtcggtacggcaggcggcttccttatcggcctctcacagctcttctccctcgccacgaggagatccatgataggcatctccaccgtctatgaagaggttggaaactatttctggtggttgaccaaaggcgcagagcccagtgcaaagcccacctcctacaacagcattctcttcgccggcggggtcacggccggagcctgggggctgctccaggccgtgccttcgctggcaagtacgcctgtctttgaggcgcctccactgctggcgatggtagggggtgcgctcatggccataggagcgcggatggccggcggctgtacttctggacacggcattagcggcatatcactgctgtcgttgtccagtatgattacgatcgcaagcacgtttgctgcaggagctgttgttgcgcctttggtgtattga

SEQ ID NO: 99 - protein, 329 aa, Trichoderma reesei QM6a
MTTTFLSGAAFGAAMMAASFHNPAIVIAQMKFENWHMMQAFLAATASSAAMYAVADRLDYVKLKPRSSSPLALFSKYDGNIIGGALLGTGMALSGSCPGTLYAQLAAGVHTGFHALNGAILGGLLWTGLLSKVVKQRKEKAKADPITVTANDQLGLSRGVTLLLFEAVCLSVLAVTTFYTPKFPGAKMVGTAGGFLIGLSQLFSLATRRSMIGISTVYEEVGNYFWWLTKGAEPSAKPTSYNSILFAGGVTAGAWGLLQAVPSLASTPVFEAPPLLAMVGGALMAIGARMAGGCTSGHGISGISLLSLSSMITIASTFAAGAVVAPLVY

SEQ ID NO: 100 - DNA, 1209 bp, Trichoderma reesei QM6a
  CDS (1)..(184)
  CDS (257)..(1206)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49821.1 (27554)
  ref <309>: DATABASE ENTRY DATE: 2006-10-18
atgaagctttggatcggcctcttgcttttgggcctcgcctgcagggcaagtgcccacacaactttcaccacgctcttcatcgacaagaagaaccaaggggatgggacgtgcgtccggatgccgtacgatgacaagacggcaaccaacccggtcaaacccatcacatcttcagacatggcttgtggtgagcatgcttctcttaccagggccgcccgaatggcagtgaagctggttcggtattgacatatatcatcaggtcgcaacggtggcgatccggtgccattcatttgttcggcaaagaaaggatctttgctcacctttgaatttcgcctctggcccgatgctcagcagcccggtagcattgatcctggccacctgggtccctgcgccgtgtacctgaagaaggttgacaacatgttctcggacagcgccgccggtggcggctggttcaagatctgggaggacggctacgactccaagacgcagaaatggtgcgtcgaccgccttgtcaagaacaatggcctgctctccgtgaggcttcccaggggactgcctgcgggatactacatcgtgaggcccgagatcctcgcgctgcactgggctgcccatcgcgacgacccgcagttctacctcggttgcgcccaaatcttcgtcgacagcgacgtacgtggtccgctggagattcctcggagacagcaagcgactatccctgggtatgtcaacgccaagaccccaggcctcacgttcgacatctaccaggacaagctgcctccgtatcccatgcccggccccaaggtgtatatcccccccgcgaaggggaacaagcccaatcaggacctgaacgcgggccggctcgtccagactgacggcctcatccccaaggactgcttgatcaagaaggcaaactggtgcggcaggcccgtcgagccgtactcgagcgcacgcatgtgctggagggccgtcaacgactgctacgcgcagagcaagaagtgcagggagagctctccgcccatagggctgaccaactgcgaccgctggagcgaccactgcggcaagatggacgcgctttgcgagcaggaaaagtacaaggggccgcccaagttcaccgagaaggagtacgttgtgccggcgccggggaagctgccggagatgtggaacgacatctttgagcggcttgagcagaacggaacttctaccaagtttttttga

SEQ ID NO: 101 - protein, 378 aa, Trichoderma reesei QM6a
MKLWIGLLLLGLACRASAHTTFTTLFIDKKNQGDGTCVRMPYDDKTATNPVKPITSSDMACGRNGGDPVPFICSAKKGSLLTFEFRLWPDAQQPGSIDPGHLGPCAVYLKKVDNMFSDSAAGGGWFKIWEDGYDSKTQKWCVDRLVKNNGLLSVRLPRGLPAGYYIVRPEILALHWAAHRDDPQFYLGCAQIFVDSDVRGPLEIPRRQQATIPGYVNAKTPGLTFDIYQDKLPPYPMPGPKVYIPPAKGNKPNQDLNAGRLVQTDGLIPKDCLIKKANWCGRPVEPYSSARMCWRAVNDCYAQSKKCRESSPPIGLTNCDRWSDHCGKMDALCEQEKYKGPPKFTEKEYVVPAPGKLPEMWNDIFERLEQNGTSTKFF

SEQ ID NO: 102 - DNA, 2336 bp, Trichoderma reesei QM6a
  CDS (1)..(524)
  CDS (642)..(820)
  CDS (898)..(1304)
  CDS (1379)..(1564)
  CDS (1623)..(1766)
  CDS (1835)..(1965)
  CDS (2057)..(2333)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR50002.1 (76852)
  ref <309>: DATABASE ENTRY DATE: 2006-10-18
atgcatctctttccggcaggcctgctcgcgctcgcctgcgttggaactgtcttcgctcagaccggcagcccagccagctacaaagtccagaaaccgccactggacactgactggacttacaaggtgggcacggatccatggcccgagtatccccggcctcaacttcagcgtgaagtctggcaaagcctcaatgggatctggacgtttcagcccgccggggctggggcaggcgactccggtagtcctccaggggggccacttcagcgcgaggtgctcgtgccgtcctgcatcgagagtgggctctcgggattgcaaatcatgaacatcaccgacatgtggtttgcgacgagctttaagataccgcacagttggagcgggcaagctgtcatcctaaactttgaggccgtcgactacgaggcagtagtgtttgtgaacggagccaaggtcgggagccacaccggaggatattttcggttcgcattggatatcaccaattccgtcaagtttggtgaagaaaacgacttgtaagtcaaccgcctctggtaattcgacggcgttggagcagcaggagcagaagatccagcttggccgacggcaaagatgcgtgtatggattcgtagcaggtattgaccaggaagcagaactgtcttcgttcacgatcccaccgacctggatgtcattccgatcgggaagcagactcggaatccgagccacatcttctacaggtcgtgctccggaatctggcaatctgtgtggctggagagtgtgccttcaaaccacatcacacagcttgacgttgccgcaggcatggatggaacaggtatgaagtcatcaggatgccctccccggcgatgtctagtagtggcagtccacgtctcgtctaacgcaatgctctagtttgcgtaaccgttcacagttcgaagaagcaaggagcctcggccaaagtgtccgttattgggctcgatggtcgaactattgcttcccacaggggcccttcagatgaggagttcaagttcaaggtcaagcaccccaagctttggtccccatcctctccgactctgtacaatttgacagtgacccttgccgatgatgaggtgtccagttatactgggttccggacagtctcctctggaaaagttaaggggattcagagaccgctgttgaacggagagttcaccttcatgtttggtacgctcgaccaggggttctggccagacgggctatatgtgccgcccaacagagaagcccttgtatacgatctgaagatgctcaaggggctgggcttcaacaccgtcagaaagcacgtaagtggcccgttgatccggttgttgccaacgacgcagtcaagtagacagctgacatgagcggtttgtcacagatcaaggttgagccggacttgttttaccgagcctgcgacgagatgggtttgatggtcatccaggacatgcccagtctgaccaacgacgggagtcggcctcctaacccggaccaacaggcggagttccaacgtcagctggaagtactggtcaatgagcataagaactacccgtcgattgtgacatgggtccgtctttccccacgaccctgcccatagtagttgagactgaccaagccattcgtaggtcatctataacgaaggatgggggcagctcaggggcccaccgtatcctgaagagaagcttgtggaactggtgcgcagcatcgaccccacgaggctcatagacgcgacgacgggctggaacgaccacggggcaggcgatttctcagtaagccgattgcatgtcgatgagctcccagaggagagaagctggctgaccaaggcgtaatgacttaggacaaccaccattacgccaatccgcaatgcggcacgcctttctactccaccccttcatctccgtacgaccccagccgcattgggttccagggcgagtttggtggcgtcggccacaacgtgtcaatcgaacagttggtcttccatatctcctctgcacccttatggcgtattgtccagtaagggcgtattttgtggatgccaagtgcctaacagtattattagtctttggaatgtccaagaggccatcaacaccatcaaccagacgtacgaagtcgacgctgatctggctacttacaactaccgcgcgggcgtcctgttccgcgagtttctcgagcaggtggagcgctatgcttgcagcggcggcatctggacacagacgaccgacgtcgaaggcgaagtcaacggtctctacacgtatgatcgtcgagtgctgcggcctgacgcgaggcagtggaagagcgatatcaaaaagctgtacagcgctgcggcaggtaggcgatga

SEQ ID NO: 103 - protein, 616 aa, Trichoderma reesei QM6a
MHLFPAGLLALACVGTVFAQTGSPASYKVQKPPLDTDWTYKVGTDPWPEYPRPQLQREVWQSLNGIWTFQPAGAGAGDSGSPPGGPLQREVLVPSCIESGLSGLQIMNITDMWFATSFKIPHSWSGQAVILNFEAVDYEAVVFVNGAKVGSHTGGYFRFALDITNSVKFGEENDLTVFVHDPTDLDVIPIGKQTRNPSHIFYRSCSGIWQSVWLESVPSNHITQLDVAAGMDGTVCVTVHSSKKQGASAKVSVIGLDGRTIASHRGPSDEEFKFKVKHPKLWSPSSPTLYNLTVTLADDEVSSYTGFRTVSSGKVKGIQRPLLNGEFTFMFGTLDQGFWPDGLYVPPNREALVYDLKMLKGLGFNTVRKHIKVEPDLFYRACDEMGLMVIQDMPSLTNDGSRPPNPDQQAEFQRQLEVLVNEHKNYPSIVTWVIYNEGWGQLRGPPYPEEKLVELVRSIDPTRLIDATTGWNDHGAGDFSDNHHYANPQCGTPFYSTPSSPYDPSRIGFQGEFGGVGHNVSIEHLWNVQEAINTINQTYEVDADLATYNYRAGVLFREFLEQVERYACSGGIWTQTTDVEGEVNGLYTYDRRVLRPDARQWKSDIKKLYSAAAGRR

SEQ ID NO: 104 - DNA, 1439 bp, Trichoderma reesei QM6a
  CDS (1)..(118)
  CDS (194)..(634)
  CDS (757)..(1436)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR50010.1 (76862)
  ref <309>: DATABASE ENTRY DATE: 2006-10-18
atgtcgcgccggcatcacagcagtcgcgccagcacgcgatgggcggtgcgcatcgttcccttgtttatcctcggcgtgttagccgtggccacctacgcagtcgtcgatcgcctgtgtggtgagttggagtctcttccagacggaaaacgatggggagcccgcttcttgctgaccagcatctctcttcatctagtcaactacctataccgaaagaagcaccaggccggcgtcgttacggcattcctcgtcctctatttcctcttcttcctcctcatgatggccgcctacctccgaaccttctttaccgtccagttgaaaccaggcgtcgtccctctggctcctgaggagcaaaccgaacgtgaggctgctgagaagctacgaaaacgacacaagcgcaaccgagatgtcgaggacagggcgctggcgcctcccgacccaaacccggacagccccgggctcgaggccttctacagcaaagacgtcttcgtctgtgaggctgacggccgtcctaagtggtgctcagagtgccagcaatggaagcccgaccgctcgcatcactcgagcgacctgggccgctgcgtcaggaagatggatcatttctgcccttgggttggtggcatggtctctgagacttgtgagtttacagcatcccccttttcgcagagagaacagagagcccacgtctcgttctggatgctggtcaagagagaattttggaatctaaacagacgatcctgtcctttgcggggaccgtagccttcaacttctttacgcagttctgcttctattgcggcctcttctgcgccgtgagtctcgccgttggagcatattctttccagcagcaccacaaagatggagaccctattgacggctgggcccttgcgattatcgttttgtcctgcattttcggtgcctttacgacgggcatggcgctcacctccattcgctacatcctcatcaacacgacaaatgtcgacatgcttaagaggccacagaccaccacgttggcggtccgcatccccctgtctactccgccgtcggacaagtataacgtcattgtttatccgcttcgaggcccgccgcgacgacctggctccgagggccagcagcctcacacccatcacggccccatgtcttccagagatcagcaggcggagcgcaagtttgccatcctccgcacgaaaccacgcgagaatccatgggatctgggcgccatgaaaaactggaagtccgtcatgggagacaacttcttggagtggttacttcctattcgacactccccctgctgcaaccacgagagtatggagagcgattaccgattcggccctctagtctccaggttgaggaaacgctatggagtccccgagctgagcacctcttcccgcagcggacatggcgtcgagctacaggagagagcgagccgacgcgccagtcagtga

SEQ ID NO: 105 - protein, 413 aa, Trichoderma reesei QM6a
MSRRHHSSRASTRWAVRIVPLFILGVLAVATYAVVDRLCVNYLYRKKHQAGVVTAFLVLYFLFFLLMMAAYLRTFFTVQLKPGVVPLAPEEQTEREAAEKLRKRHKRNRDVEDRALAPPDPNPDSPGLEAFYSKDVFVCEADGRPKWCSECQQWKPDRSHHSSDLGRCVRKMDHFCPWVGGMVSETSFNFFTQFCFYCGLFCAVSLAVGAYSFQQHHKDGDPIDGWALAIIVLSCIFGAFTTGMALTSIRYILINTTNVDMLKRPQTTTLAVRIPLSTPPSDKYNVIVYPLRGPPRRPGSEGQQPHTHHGPMSSRDQQAERKFAILRTKPRENPWDLGAMKNWKSVMGDNFLEWLLPIRHSPCCNHESMESDYRFGPLVSRLRKRYGVPELSTSSRSGHGVELQERASRRASQ

SEQ ID NO: 106 - DNA, 2120 bp, Trichoderma reesei QM6a
  CDS (1)..(112)
  CDS (389)..(430)
  CDS (547)..(2117)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49832.1 (59740)
  ref <309>: DATABASE ENTRY DATE: 2006-10-18
atgtcacacgcgccgggatccgagccccacaagcggaaacggagtattgaggatgacggccgccagcttgcgtatcatcgccagggccagccctcgtcaggcctctcttcatgtatgtctattcctcctcttgaagcgatagcctctcacacattccttttgattcctcatgctccctcatgcccgccgaccactgcaaagctcgctcgccacatcggcttgcgtgcccccaacccccgtctccttttcactgtgtcatctatcgtgcatcgtgctccacgcagaagaatgaatcaatgttaatcaagcccagcggctcccgaatccatcatcaaattcacgccaagaaacaactcccagcttttagccttgctgccaggcgatgcagataccttcagcgacatcgtctacctcattagtgaatatgaaggtatgcttccatctgcgcgccttgttccttacccggtcacggcatacccatgcccatgcccatgccctgaatatgcgttgtaaagaatgtgctgacagggtgcactctgcgtgcaggcgtcatggaccgcagcgaaagccttgcggccaatcttggggccaagctgacaggtccccgattcctacgcggcctcgaaaggttcttcgagggcccaatcagcatcaattcgcccaatccagacgcccagcaagtcacctggttggacgtggtcatgttggcgaaagcgagcccggatgcatttgctctcgtctccttgcccagcggtgcacgttgctgccaattcatttaccaggggttgcaggtcgagatcaccgaggatgactggcgcctgatctcttccggagcactggacaggttcccactggagcacacgttcgaagaggacgaggcggccgagctggcgacactcgagattctccaacagcgggccttgctgctgcataggagggcagacgaagttgcggagagggctcagatcctgcgtcagagactcgagcttcgcagacatgtcatttctcggcggcaacaactccataatggcacctccagctccagctccagctccggctccagctccagctccggctccagctccagctctagtcctagcttccatgccatcaatcacctaccgcgttccgccatcagctcgcacttcgacctccatgcagaccttctccagcagtttaccacggctgcaatgcaaaacagcccaccgtcaggggcgcctccggaataccaaccacggcccacgtcggtgtctagccagggttcgctggcaccgccgagcttggaagcaccgccgtatcagccgccctcggccgcggaaccacccttggccccggcaccagcccccatgtcaacgtcggctgcgagtccatcatccacagcgccagctttgacgccgacgtccaactcgcggtccattgcgacaatggccatacgccaggcggcgcttcccggcgacccggccacggaagtatacaggccccttgtactgcagaagacggacacgctcaacaagggcgacgttatattcccaccctgcgaccgatgccggcgtctccgcctgcagtgcattaagcatctgacggcgtgtcggggctgcaccaagaaacacgcgagatgcaactggaggaacatcactgacgacgaagccgcggctataaaggaggatctggaaaagatacgccgcgaggcacagaaggcggcggcagcggcagcggcagcacggcagcagtccaatgccggcggcaatcctcggccttatgaggcgggccccagcgcgccggcaagctacggcgcaggaaccatggggccaacgccgtcactgcttgctccgcttgcttccctcgctcctctagctcctctagctcccctggctcctttgactcctttggctcctttggctcctctgactcctctggctcctctggctgctctggcgccggccgctgctcccgagccgcctcgaagactgctgcccacggcccgactcaccgggatcgagccaacgcccaccacgcctcgaagccctccgcggcgaacggggcagctcgcctccatcttgtcgcctcctgactatgagccgcagccgtttgggatgttgccggatctggccccaagatga

SEQ ID NO: 107 - protein, 575 aa, Trichoderma reesei QM6a
MSHAPGSEPHKRKRSIEDDGRQLAYHRQGQPSSGLSSYTFSDIVYLISEYEGVMDRSESLAANLGAKLTGPRFLRGLERFFEGPISINSPNPDAQQVTWLDVVMLAKASPDAFALVSLPSGARCCQFIYQGLQVEITEDDWRLISSGALDRFPLEHTFEEDEAAELATLEILQQRALLLHRRADEVAERAQILRQRLELRRHVISRRQQLHNGTSSSSSSSGSSSSSGSSSSSSPSFHAINHLPRSAISSHFDLHADLLQQFTTAAMQNSPPSGAPPEYQPRPTSVSSQGSLAPPSLEAPPYQPPSAAEPPLAPAPAPMSTSAASPSSTAPALTPTSNSRSIATMAIRQAALPGDPATEVYRPLVLQKTDTLNKGDVIFPPCDRCRRLRLQCIKHLTACRGCTKKHARCNWRNITDDEAAAIKEDLEKIRREAQKAAAAAAAARQQSNAGGNPRPYEAGPSAPASYGAGTMGPTPSLLAPLASLAPLAPLAPLAPLTPLAPLAPLTPLAPLAALAPAAAPEPPRRLLPTARLTGIEPTPTTPRSPPRRTGQLASILSPPDYEPQPFGMLPDLAPR

SEQ ID NO: 108 - DNA, 1637 bp, Trichoderma reesei QM6a
  CDS (1)..(166)
  CDS (233)..(1255)
  CDS (1312)..(1634)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR50026.1 (59396)
  ref <309>: DATABASE ENTRY DATE: 2006-10-18
atggcgagcgacaaagtcacatacagccagtttgcctgcatcggcactggcttttccggaatagccctgggatgcaccatcaagaggtggtatggaatatgcgatattcgcttctttgagaaaaacagcgatctaggcggcacctggttcgtcaaccagtatccaggtacctctcagctctaatcccgctttctcttccctctctctgcccttggctctaatgctttgccagggtgtgcttgcgatgttccgagccttctctacagcttctcctttgccccgaacccggagtggtccaaagtgctgccctccaaggacgagctttggaactatctcagcagagtctgcgaccagtacggtcttcgtgacaagatgtccttcaactccaccgttgagaggtgcgaatggattgaacaaacggctcgatggcgcatcactgtccgggacacagcctccaacaccactttcacccacgaatgccagtttctctacgctggctctggcctcttggtttatcctcgcaaggcagatctaccaaacatcgaaagcttcaacggccccgtcttccacgcctcccaatggcgccacgatgtcgacctgacagacaagaatgtcgtcgtcgtaggcaatggttgttcggcttcgcagattgtcccggccatcaaagatcaggtgaagcacgtcacacagttcgcaagatccaaacactggatcgttcccgatgtcaaagtcccccacacaaaggtgttccagtggctgtttatgcatattccaggagtcatggccttgggccgctttgccgttttcttgttcatggaaaatagtgcaagggcattcggaatggataaggcttctgccgcctatcgccgtcaagtgactgccgaggcggagcaattcatcaaggataatgcccctgaaaagtaccatgacatgctgattcccgactttgaactcggctgcaagaggcgcatcttcgacccaggatatctggggagcctgcactccgatagggtcacgcttcgggacgatcccatccaggaggtgacgccccacggcattcgctcaaaaaatggcttcactgaggccgacgtcattgtgctggccactggctttgagacaaatacattctgcacaggcatcgacattgttggtcgtggaggggtgacggcagaggagcattggaagtctctcggcgggcctggagcatacaactcgaccaacatctcaggcttcccgaacttcttcctcttgttaggtgaggcatcgtcatcctccattactcattctccgggaggttctaacgtgtgacaggccccaacacagcgacgggccacacgtcaaccgtcatggccatcgagaacggcgtcaactactccctccggcttattgagcccatcctgcaggggaaggccacggctgtcgacgtcaagctcgacgcggagaagtcatacacgagccagatccagacagctctccaggatacggtgtggctttccgggtgcaacaactggtacaaccgaacgcaggacggaacagtgcgcaacgccatggtctatccttattcgcaggcctacttctggtatcggtgcctgttcccggtttacgacgatttcgaatacgatgtgagttggtcctga

SEQ ID NO: 109 - protein, 504 aa, Trichoderma reesei QM6a
MASDKVTYSQFACIGTGFSGIALGCTIKRWYGICDIRFFEKNSDLGGTWFVNQYPGCACDVPSLLYSFSFAPNPEWSKVLPSKDELWNYLSRVCDQYGLRDKMSFNSTVERCEWIEQTARWRITVRDTASNTTFTHECQFLYAGSGLLVYPRKADLPNIESFNGPVFHASQWRHDVDLTDKNVVVVGNGCSASQIVPAIKDQVKHVTQFARSKHWIVPDVKVPHTKVFQWLFMHIPGVMALGRFAVFLFMENSARAFGMDKASAAYRRQVTAEAEQFIKDNAPEKYHDMLIPDFELGCKRRIFDPGYLGSLHSDRVTLRDDPIQEVTPHGIRSKNGFTEADVIVLATGFETNTFCTGIDIVGRGGVTAEEHWKSLGGPGAYNSTNISGFPNFFLLLGPNTATGHTSTVMAIENGVNYSLRLIEPILQGKATAVDVKLDAEKSYTSQIQTALQDTVWLSGCNNWYNRTQDGTVRNAMVYPYSQAYFWYRCLFPVYDDFEYDVSWS

SEQ ID NO: 110 - DNA, 1479 bp, Trichoderma reesei QM6a
  CDS (1)..(214)
  CDS (338)..(1476)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49837.1 (76887)
  ref <309>: DATABASE ENTRY DATE: 2006-10-18
atgaggccgccaacgtcgttgtcagcagctctgacgctgctcctcgcgacggattacattgaagccatcgctactcccgttttcccgagagcgaaatctggggatgggtatttggcgattcccgtgggaaccatcccgaggccgcgcaaggtcggcaagagaagcgccatcgatgctacgctacagaacatggactttttctatgccattcaaggtaatgcatcacctttgttaacaccaccagaagcttctgttcagctcgtgtctctatcgtccgctttcaagtgcactacctagggtctgcaaagtgtacatgctaataaatggtcggcaacagtcggcatgggaacgcctccccagaatgtgaccgtcctcgtcgacacgggatccagcgagctatgggtcaatcccgactgctcaaccgcaccgtctcagcaacaggccgacatgtgcgagaatctgggccagtacaaccccaggagatcaaggacaccgcccgtcggcccgtttgggcgtgaagagatcaactatggcgaccctacggaccagtccacgcagacgtcggtcgacatcacctactatgccgacacgctgagctttggcagcatccaggtcaagaaccagacgtttggcgtcgtcacggccagcgacggccaggcgcagggcatcatgggcctcgcacccgacgtccggggcggcttcccaggggacgagccgtacagcctgctgctcaacaccatggccgagcagggcgtcattgcaagccgagtgtttgcactcgatctccggcattccgactcggagacaggcgccatcatctacggcggcctcgatcgcagcaagtttgtcggatctctcgaggcacgtccgattgtgcgcggcatcaagggcgaaactcggctggccgtcaacctcacgacgctgggccttaccctgggccggtcccagagcttccggctctctgctgccgacaccaacgtgatgctcgactccggcacgacgctcagccggatgcacgaggctgctgccattcccatcctcgaggccctgggcgcgcaagacgccggcgagggctacttctacgtgccgtgctcgacccggaacgctggcggcagtgtagatttcggcttcggcaacaaggttgtccgcgtccccttttccgactttatactgacgggcgaagattcgagcgactcagactattgcttcgttggcatcgtcatcaccaccgaccagcagattctgggcgacacggtgctgcgggccggatactttgtctttgactgggacaaccgggaggttcacattgcccaggccgcggattgcggcagcagtgacattgttgttgttggcagggggtccgatgccgttcccagcgtgcaggggaactgcaatgagaacgaagcgtttcccaccggctcaggaagcccaacggtaagcatctcttttgtccaaactgcattcacggccaacgactaa

SEQ ID NO: 111 - protein, 451 aa, Trichoderma reesei QM6a
MRPPTSLSAALTLLLATDYIEAIATPVFPRAKSGDGYLAIPVGTIPRPRKVGKRSAIDATLQNMDFFYAIQVGMGTPPQNVTVLVDTGSSELWVNPDCSTAPSQQQADMCENLGQYNPRRSRTPPVGPFGREEINYGDPTDQSTQTSVDITYYADTLSFGSIQVKNQTFGVVTASDGQAQGIMGLAPDVRGGFPGDEPYSLLLNTMAEQGVIASRVFALDLRHSDSETGAIIYGGLDRSKFVGSLEARPIVRGIKGETRLAVNLTTLGLTLGRSQSFRLSAADTNVMLDSGTTLSRMHEAAAIPILEALGAQDAGEGYFYVPCSTRNAGGSVDFGFGNKVVRVPFSDFILTGEDSSDSDYCFVGIVITTDQQILGDTVLRAGYFVFDWDNREVHIAQAADCGSSDIVVVGRGSDAVPSVQGNCNENEAFPTGSGSPTVSISFVQTAFTAND

SEQ ID NO: 112 - DNA, 2118 bp, Trichoderma reesei QM6a
  CDS (1)..(46)
  CDS (215)..(2115)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR50032.1 (59270)
  ref <309>: DATABASE ENTRY DATE: 2006-10-18
atggctcagaacccggcagacgagctccttcggcgtccgttatatggtaagtaaaagcactttgtcgcgccactggcaaggcctaccaataccggccgagacacgggacacgagacatacagcttataggacacgcgctgtttcttgcccgagtctcgatttgattctacgatctctgaacaagtgctgacaacttgcgccaacgcggtcttagtctacgatcttccgccagaaagcctcgcaggcttgacgctgaaaccggacgcggacgcaatcgccgtcgaggaacccgagacgtcaacgattcccagccaggcttcggactcgtcctccgacagctttgtcggttcccaagcatgctctctctgcaagctttccttcaccaccgtattagaccagcgaagtcacatcaagtccgattttcacaattacaatctcaagcagaagctgcggggtcagggcccggtctcagaggccgagtttgaaaagctgattgagactctggacgaatcgctctcgggctccgactcggaagattcggaagacgacgaggacgaagggcgtcaggattctacgcttacggcgctgcttaagaagcaagcaaagctgacggagagacgaaacgccaccagagagaataacaaacaaggcgataatgacgacgatgaactctcagggaggccgggcaaggggaagccggcgctgatatggttcagctcgccgttgcttccagaaaacacgtatttcggcatctaccgagcgatatttacagatgaagagcaacgccagcccgacttggtcgaggtcatccggaagaagcagctcgagcccatagccatgcctaagcctgcaaaggacgggacgctgccgccgatcgcgtacaaggggccgcacttcttcctctgcatgatcggaggcggccattttgccgccatggtcgtctccctcgcgccgagagccgccaaatcgggcagcacaaccatgaaccgagaggccacggtcctcgcccacaagacctttcacagatacacgacgcgtcgaaaacagggtggttctcagtcggcaaacgacaacgccaaaggcaaagcgcactctgtcggctcgtctctgcgtcggtacaacgaaaccgccctggtcgaggatgtgcgcgctcttctccaggactggaaggggctcttggactcttccgaactgcttttcatcagggcaacaggaacgacaaataggagaaccctgtttggcccctatgaaggacaagttcttcaagccaacgacgctcgtatccgagggtttccatttagtaccaggagagctactcagaacgagctgatgcggtccttcatcgagctaactcgactcaaagtcagggagattgctccaagcaaggcaggactagacaaggcgaacggggcaccaagcaaacctgcgacaccatccaagccggcaaagccgacgttgtcagaagaggaggaaacggcgctgcttcatacgtctcagctacaagcctttgtacggcggtccaagctacctgcacttttatcgtacctcacaaaaaataacctggatccggactttgagttctatcctccggaacaaaactaccatacaccacgccttttacactacgcagctgctcagaactctgctcctttggtgctggggatccttacacgagccggggcgaacccgttgctcaagaacgcggagggaaagacgcccttcgagctcgctggagatcgctctacgcgggatgcctttagagtagcccgctctgaagtaggagaggggaaatgggactgggatgcggccaaggttcctcccgccatgaccaaggacgaggcagatcgccgtgacgagcgggaaaagcaagaagcagataagaaggagtccgacaggagaaaagcggaagaagagaggctccgtactgaagggccaaggctccctgagcagaagacgaagaagggaaacagcatagcgtccataatcgccaagacgccacaagagcgcagggaggaggaagccagggggctgacgcccgagatgaagttgaaactggaacgagaaagacgagcgcgagcggcagaagagagaatcaagaggctacagggtggtagttga

SEQ ID NO: 113 - protein, 649 aa, Trichoderma reesei QM6a
MAQNPADELLRRPLYVYDLPPESLAGLTLKPDADAIAVEEPETSTIPSQASDSSSDSFVGSQACSLCKLSFTTVLDQRSHIKSDFHNYNLKQKLRGQGPVSEAEFEKLIETLDESLSGSDSEDSEDDEDEGRQDSTLTALLKKQAKLTERRNATRENNKQGDNDDDELSGRPGKGKPALIWFSSPLLPENTYFGIYRAIFTDEEQRQPDLVEVIRKKQLEPIAMPKPAKDGTLPPIAYKGPHFFLCMIGGGHFAAMVVSLAPRAAKSGSTTMNREATVLAHKTFHRYTTRRKQGGSQSANDNAKGKAHSVGSSLRRYNETALVEDVRALLQDWKGLLDSSELLFIRATGTTNRRTLFGPYEGQVLQANDARIRGFPFSTRRATQNELMRSFIELTRLKVREIAPSKAGLDKANGAPSKPATPSKPAKPTLSEEEETALLHTSQLQAFVRRSKLPALLSYLTKNNLDPDFEFYPPEQNYHTPRLLHYAAAQNSAPLVLGILTRAGANPLLKNAEGKTPFELAGDRSTRDAFRVARSEVGEGKWDWDAAKVPPAMTKDEADRRDEREKQEADKKESDRRKAEEERLRTEGPRLPEQKTKKGNSIASIIAKTPQERREEEARGLTPEMKLKLERERRARAAEERIKRLQGGS

SEQ ID NO: 114 - DNA, 1871 bp, Trichoderma reesei QM6a
  CDS (1)..(79)
  CDS (168)..(220)
  CDS (372)..(626)
  CDS (774)..(1589)
  CDS (1647)..(1757)
  CDS (1827)..(1868)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49850.1 (3397)
  ref <309>: DATABASE ENTRY DATE: 2006-10-18
atgttctatcaggggagcctgcaagagggtatctccacggcggtgggccagcagaagctcgtcctctgcttcgtgacaagtgcgtgattcaatcgccgagccctgccattgtttgggcatcttgtattccccaaattaagcttgcactctgtctgacaccaacatagatgaaaatgaggagagtcagacgtgggagaatgaatatctacaagacagctcggtaagtcgctcccttccgctccctgcaagctggaacgttgcggcacagaacatgtgcagcagtacatggcagatcggatggagataaatgtatggatgggatggctaacagcttcgcctgttggaaactgcagctgtcaaaactcatcgagacgcaagcggtcgccctgcggctcatcgcagagtcggaagaggcgggatacctgtcgcaaatcttcccactgcccaagacgccaaccgtcgtcatcatgaagcacggcgagctcaaggaatacattgccgccggcacccccaaagacgacttcctccgtcgaatcctcgtggccttcaacgccgctcctcccgcgacctcggccgcatcctcatcagcctcaccgtcagcttcaccgacaaggttggctgcccctgtacccgctcctgctcccgtctccgcctccgcctccgtcaccgcccccgccccttcaacgtcgccgtcacccgcatcgcaggcacgaacacgatctcagtcacagtcacagtcacagtcacagtcacagtcacagtcacagtcacagccacagccacagtccccatcacgaccagaggcccagcttcaggctcaggtcgaggccgtgggcgccgctccacaagaagtagtggtcagccaggtcaaccagatcgaccacctcctagccgacagggcggccaagctcaaggcacagaaagaggaggccgagaagagagccaaggaggagcgggccaaggccaaggaaaaggccaaggcagaggcacaggcagctgcaaacacggacggagccagagtctacgagcaagcagaacagctcaagaagaggcgacaatcggagctcgaggagcgccgacgcatcctgaagcggatagaggatgaccgagaggaaagacgcctgcgggcgtcgcaaaaggagcagcagaggattgaaggccgaagggcgagcgacgctgctgctgcctctaccagcacgttgcagagcaagctgccgtctgcaagcactaggaaggtgtctgagatggcatcgatccaggtccgactctttgacggctcaaccatacggtcgcggttcaagacgggggatcctctgacggtagtcaggaagtgggtggacgagacccgaggcgagagcagaggcccgtacaccttcaagcaggtcctgacgccgctgcccaacaagaacattgacgcgacggaggaaagcaagtcgattggcgagctgggcctgatcccgtcttccacgctggtcctcatccccgtccaaaagtattcgtcggcttatcgcgccgaggatcaacaggcatcgccctggtcgaggttcctcgcgctgattctaggcttcttcacctggctcctgggcttggttggcttgggtggagagcagcgcgcaggtaggggcgacgggggaataggtagacaggacagcagggcgccggatgcgacggccaggaccgcgtctgaggagaggaatcgtcgggtgcgaggtttacagaacttgcagcgcgatcaccagctgtacaacggtaactcggtatgtcgcttgttttgttctccattgcatcaagaccagccatgggactgactctgtttgtgtgtgtagctgaattttgagccgcggccagacgaggacgacgacgagacatga

SEQ ID NO: 115 - protein, 452 aa, Trichoderma reesei QM6a
MFYQGSLQEGISTAVGQQKLVLCFVTNENEESQTWENEYLQDSSTQAVALRLIAESEEAGYLSQIFPLPKTPTVVIMKHGELKEYIAAGTPKDDFLRRILVAFNAAPPATSAASSSASPSASPTRLAAPPQPQSPSRPEAQLQAQVEAVGAAPQEVVVSQVNQIDHLLADRAAKLKAQKEEAEKRAKEERAKAKEKAKAEAQAAANTDGARVYEQAEQLKKRRQSELEERRRILKRIEDDREERRLRASQKEQQRIEGRRASDAAAASTSTLQSKLPSASTRKVSEMASIQVRLFDGSTIRSRFKTGDPLTVVRKWVDETRGESRGPYTFKQVLTPLPNKNIDATEESKSIGELGLIPSSTLVLIPVQKYSSAYRAEDQQASPWSRFLALILGFFTWLLGLDSRAPDATARTASEERNRRVRGLQNLQRDHQLYNGNSLNFEPRPDEDDDET

SEQ ID NO: 116 - DNA, 2121 bp, Trichoderma reesei QM6a
  CDS (1)..(207)
  CDS (334)..(524)
  CDS (620)..(1177)
  CDS (1441)..(1444)
  CDS (1993)..(2118)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR50043.1 (3400)
  ref <309>: DATABASE ENTRY DATE: 2006-10-18
atgggtgactccgatttcgacattgacttttacggcgacgccgaaggcgatgccaacgaccaagccaacgaccagcctcgccaggatgagcgccgccatagcggtggcaactcgcgagatgactacgactatcacagtcgggacaacagacaaagggaccacgaacacgaagacgaccgccgctatgagagcggccgcagcgaagatgtcgaggagcccccgcaacatcaacaacaacagcaacatcatcatcatcatcaccaacaacaacaacaacaacaacaacatcaacaacatcaccagcaacagcaacagctgcaccatggggtcaagagaaagtcggaggagcacgagcacaatgatcggcccgtcgacaacggcgccacagctgccattatgatttccgaactcaactggtggacgacagacgatgacatccgaggttggctgcgaaaggccaattgcgagagggaagtcaaggagctcactttcagcgagcacaaggtcaatggaaagagcaaagggtgagtctgcgaatacggatctcttgtggctcgctcatctttccatctgctgtttcgtatttactgacctcatctaaattgtctcgtcctattagccaagcctatgtcgagttccatacccgtcaggcttccaccgctgcaaagcgctacatcgacactgttgcctcagagggtgtgcagcccggccagaagaagatgaccatttcctactggaatcctggcgtcaacccctttaggaccctgccaaaggacgccccggcccgcgttaaggagcagccgcgagccgctccctctgggtcctacagcgatcggggcaactacggaggcttccgcggccgaggcggcatgggcggaaaccgaggcggcatgaaccccaacttcaaccggggctacggcgcaaacatgggctacaacaataacaacatgggaggtggcggcggcttcaacgggccaatgggcagacccggcggcggcggcggtactcattacgtcttcagtggccagagcagccccggagggcccatgagaggcgtccagaccatcatccgcggcagaggcggaggcggagccggcggcggcatgatgggcatgaaccccatgggaggcatgggcatgggcatgcccggcaacatgggaatgggagggaatgatgggtaacgcaatgccaggtatgcaatctgcacacactcacactctccccacccccaagaccccgccccttcaagttgtcccggcagcgggttagaactccatgtcgatgcaaacacccactacaccatcaccagtaatctcgcccacgggcgtggccgatgacgggtcacgcgaggggctgcctcaacaagagaatccactcgaggaggaacagcagcaacctctccaggacgggcagtaccccctagacgcgcctatgcagcaggctggtgagcagcaacttgccacgcagcaagcccaggagcagccgtccgacgaagtccgagctcaagtgaagcctcgggcaggacaagagaccagctgtgatgacagtgtccacgccgagcaagcgccagaggctgtggaaatagagaaccctccgcagcaagtgccaccacagccgcaagtgccgccggggcagaaccctcaagtcaacccaggaagcgcaagacaagcgtcgtttgccaggggctttctggctccctttgcagcccgcgcgcaacaatacgggcggcattactattccggctccaacggcgtcagcctgccagaaccccgggtttcgctctgcttgattcatgccacgttgacacacaactgtggtttctgccaagtggaatattggcgtcactacacctttttcattgacggctatcgtcaccatggccacgttccaccaccgccactgcccatctttccacgaccagtcccccagcctagtccgtctctttacgcgttccctcgccctcttaatgacacgctgctaatttgtgcataggcttccaaggcatgcctcccaactttccaggcggattcggcttcggacagcaaggcggcggcggaggtaatagtggtggtgactggggcaaccctcacggcgcaaagcgacctcgtcccgagtaactga

SEQ ID NO: 117 - protein, 362 aa, Trichoderma reesei QM6a
MGDSDFDIDFYGDAEGDANDQANDQPRQDERRHSGGNSRDDYDYHSRDNRQRDHEHEDDRRYESGRSEDRKSEEHEHNDRPVDNGATAAIMISELNWWTTDDDIRGWLRKANCEREVKELTFSEHKVNGKSKGQAYVEFHTRQASTAAKRYIDTVASEGVQPGQKKMTISYWNPGVNPFRTLPKDAPARVKEQPRAAPSGSYSDRGNYGGFRGRGGMGGNRGGMNPNFNRGYGANMGYNNNNMGGGGGFNGPMGRPGGGGGTHYVFSGQSSPGGPMRGVQTIIRGRGGGGAGGGMMGMNPMGGMGMGMPGNMGMGGNDGLASKACLPTFQADSASDSKAAAEVIVVVTGATLTAQSDLVPSN

SEQ ID NO: 118 - DNA, 1277 bp, Trichoderma reesei QM6a
  CDS (1)..(540)
  CDS (656)..(848)
  CDS (955)..(1068)
  CDS (1144)..(1274)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49860.1 (106164)
  ref <309>: DATABASE ENTRY DATE: 2006-10-18
atgccttttccatacaaggacgacatcaccggcgccgagctggtcgccgaatacgccccctttatcaagaacaagaccattctcaccaccggcgtctcgcccaacagcctcggagccaactacgtcgagaccattgctgccggacagcccaagctcctgatcctcgccggccgagacctgaccaaggtgaagcaaacagccgagtccatcagcaaggcgcatcctaatgtccagacacgagtcctccagctcgacctcagctcctttgctgccgtgcgaagggcggccgccgaggtcaactcatgggacgacgtgcccgccatcgacgtgctgatgaacaacgccggcatcatggctgtgccgtacaagatctgcgaggacggatacgagagccagctcacgtgcaaccacctgggtcactttctcctgaccaacttgatctttgacaaggtccttgcttcgacggacaagcgcgtggtcaacgtcagcagcggcggccactggttcagcgcaatccgctacgccgacatcaactacgatgtaagtgcagccagacctgttgtatcctaaccgaccaacccctttgtttgttttgattatcgtcgtgtgtgtcgcagatgactgacttgttggagcgggatggatggtggtacagggcggcgagacgtacgagaagtggaacgcgtacggccagtccaagacggccaacattctcttttccatcggcttggcaaataagtatggcgaccgcggcgtgctggcttacagcttgaatcccggagcgatcgcgacgacgaatcttgcgggacacttggactttgctcccgggggggatctcgactcgctgggtgagtttgattgtcagcatcaactgtcaactgctggcttcctgtcgttgatggtacggggttatgttgctaacttgtcatttgtttttgccttcttgttctgcagcacgaatcactcggttgactgcgtcgccgttgggctggatggaaaaggagttgctttcacttgaacgaggagtggccacgcacatcttcgcgtcttttgatcctgtcctcaagggtacgttttgtcccccctctcattgataattacagtacaggcagcttggctgatgatttcgtgttcttccaatagaccacaatggcaagtatctgctggaaaaggcccgcgtggccgattactatgtcgacccggtccatccccatgccattagcaatgtcgaggcggacaagctgtgggagctgagtgtcaaggcagttggactgtag

SEQ ID NO: 119 - protein, 326 aa, Trichoderma reesei QM6a
MPFPYKDDITGAELVAEYAPFIKNKTILTTGVSPNSLGANYVETIAAGQPKLLILAGRDLTKVKQTAESISKAHPNVQTRVLQLDLSSFAAVRRAAAEVNSWDDVPAIDVLMNNAGIMAVPYKICEDGYESQLTCNHLGHFLLTNLIFDKVLASTDKRVVNVSSGGHWFSAIRYADINYDGGETYEKWNAYGQSKTANILFSIGLANKYGDRGVLAYSLNPGAIATTNLAGHLDFAPGGDLDSLARITRLTASPLGWMEKELLSLERGVATHIFASFDPVLKDHNGKYLLEKARVADYYVDPVHPHAISNVEADKLWELSVKAVGL

SEQ ID NO: 120 - DNA, 2772 bp, Trichoderma reesei QM6a
  CDS (1)..(33)
  CDS (56)..(217)
  CDS (268)..(349)
  CDS (403)..(2498)
  CDS (2566)..(2769)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49863.1 (59364)
  ref <309>: DATABASE ENTRY DATE: 2006-10-18
atgagcacctcagaggatcgatcatcgtcatcagtctgctaactcccatgccaagcaacagccctttgatgccactgttgaagatgcccagaccagccacacggaaattgaagacacaaacattgccgccgtgggccgtgatctcgtcgttaccgaagatgacttgctcgaggctagagatacggcagcttcttactctctcgaggatgtgcgcagggtcagttatcctccccttctcgctgatggaaatccgcgctcacggaacagatattgaccattgtacacaatcgtcacaaacatgatctcaatttcccttccgccgtgcttctcagaattggagacttcctcggtatgtccatatccggaactcagtgtgctctcactcactgaccagccaaaaagacaatgacttcatctttgacaatcctgaaaagcaccatcgcctcatcgaggagatgaagattgaaaccgccctcattgtcaacaacagtccatatgcccccgtccgggccatcgtcgacaaccatgatgacccgtctctccccgtatccacggtccgtgcctggtgcatgggcatcgtcttcgcctccggcgtctcctttatcaacgccttcttcgccattcgactgccagcaattgccgtgggcagcaatgttgtccagctgctagcctatccagttggcaagttcctggaaaagaccctccctgattgcggttttactctctttggcgttcgacatagccttaacccaggcccctttaacaagaaagagcacatgctcgtgtctctcatgtccgccatctccgtcagtcagccctacacaaacaacatcatatggattcagtacctccccaggttcttcaatcaggcctgggccaagagcatgggttaccagcttctcgtcgctctgtccaccaacttcatcggctatggcttggctggcctttgccgccgcttccttgtctacccttccttctgcgcctggccgttgaccctcgtcactatcgccctcaattcggcatttcatgcggatgaaaatcctgccgttcccggccccttcaacaaggtgtggaccatgtctcgcttcaaattctttgcgtttgcttttctcgccatgttttgctggttctgggtgcctggatatctcttcacaggactctccgtcttcagctggatgacttggattgcgccccagagtaagaccgttggtatcctcaccgggtcgacgtcgggcctgggctttaacccttttccaacatttgactgggccgttctcaccaccgacatcgagccactcatcacccccatcttcagcaccatcaacctcttctgcggtacctttttctttggcctcgtcatcttggccatctactacaccgacagctttcacagttcccactttcccatcgtctctaatacgctctttgaccgcttcggcaaggcttacaacgtctcctccattatcgacagtcgcggtatccttgaccccgatgcataccatgcctattcgcctccctacgtctctgccggcaacacaatcaccaactttagcttcttcacgatttacaccggtgccctcacctacggcctgctctaccaccgccatgacgtgatccacggcttcacctcgctctttaacagcttccatccgtccaagaagaaggagatggccgaggctgaggctctagatgttcataaccgcttgatgaaagcttataaggaagttcctgagtggtggtatctatcagtcctggccgtgagcatagtactcggatgtgtcgccttggctcactacccaacgtacacctcgcctggcgtcgtcttcttcgggatcgcattggccctcatctttgttgtgcccacgggcattatcctctccatgaccggcatagaggtgtctctcaacgttctggccgagttcataggcggttcctgggtcgagggaaacgccttggccatgtgctacttcaagacgtttggctacatcacctgctcgcacgccctgcacttcagtgccgacctcaagattgcccactatctcaagattccgccgcgcatcatcttctgcgcccagatgattcccacactcttctccaccgtcatatgcgttgccgtcttgcagtttcagataaatctcgacaacgtctgcgccccgaccggcgccccctacgcctttacttgcccgaatgcaaattccttcttcaccgccgccgttctctggggcactgttggccccagacggctgtggggggccaacggcacctatactgccactcttgccggcttccccattggtattgccgttgtccttgtcttttggctgctcggtaagaagtttcccaggaactccatattgcgaaacgtccatcccgtcgtcatgctgtatggaggctgtctctggaacccgctcaacctcacctacatatggcccgctgtgcccattgcctgtgtctcttggctctggatcaaggtccgttatctggcattttgggccaaggtacgtctttacctgcaatttcgagctctgctacatgtaacagctgattcccatggcctacctctagtacaactatattctgtccgctggtttctctaccggccttgccatttctgccctcattcagttctttgccctgacgtaccatggcatccacctcaactggtgggggaacactgtaatcaccaagggctgcgacctctttggcctctgcaggctgaacccaatggctcctggagagtcttttgggcccggtccgggagaatttcgatga

SEQ ID NO: 121 - protein, 859 aa, Trichoderma reesei QM6a
MSTSEDRSSSSQQPFDATVEDAQTSHTEIEDTNIAAVGRDLVVTEDDLLEARDTAASYSLEDVRRILTIVHNRHKHDLNFPSAVLLRIGDFLDNDFIFDNPEKHHRLIEEMKIETALIVNNSPYAPVRAIVDNHDDPSLPVSTVRAWCMGIVFASGVSFINAFFAIRLPAIAVGSNVVQLLAYPVGKFLEKTLPDCGFTLFGVRHSLNPGPFNKKEHMLVSLMSAISVSQPYTNNIIWIQYLPRFFNQAWAKSMGYQLLVALSTNFIGYGLAGLCRRFLVYPSFCAWPLTLVTIALNSAFHADENPAVPGPFNKVWTMSRFKFFAFAFLAMFCWFWVPGYLFTGLSVFSWMTWIAPQSKTVGILTGSTSGLGFNPFPTFDWAVLTTDIEPLITPIFSTINLFCGTFFFGLVILAIYYTDSFHSSHFPIVSNTLFDRFGKAYNVSSIIDSRGILDPDAYHAYSPPYVSAGNTITNFSFFTIYTGALTYGLLYHRHDVIHGFTSLFNSFHPSKKKEMAEAEALDVHNRLMKAYKEVPEWWYLSVLAVSIVLGCVALAHYPTYTSPGVVFFGIALALIFVVPTGIILSMTGIEVSLNVLAEFIGGSWVEGNALAMCYFKTFGYITCSHALHFSADLKIAHYLKIPPRIIFCAQMIPTLFSTVICVAVLQFQINLDNVCAPTGAPYAFTCPNANSFFTAAVLWGTVGPRRLWGANGTYTATLAGFPIGIAVVLVFWLLGKKFPRNSILRNVHPVVMLYGGCLWNPLNLTYIWPAVPIACVSWLWIKVRYLAFWAKYNYILSAGFSTGLAISALIQFFALTYHGIHLNWWGNTVITKGCDLFGLCRLNPMAPGESFGPGPGEFR

SEQ ID NO: 122 - DNA, 1407 bp, Trichoderma reesei QM6a
  CDS (1)..(101)
  CDS (166)..(299)
  CDS (422)..(1404)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49876.1 (3422)
  ref <309>: DATABASE ENTRY DATE: 2006-10-18
atggccctcgtcagtcgcatctggggttgcttcaacccacccacgccccccaaatccagcgatgccatcaggttcggcgtcctgggagctgctggcattgcgtgagtctacttatatatcattctcccattgtatcgaagaaggtttattaacaaatgtccacagaccccttgccttgttcaaccccgccaagtcccatcccgaagtcatcatccaagccatcagcgcccgtgatcgcaaaaaggcagaggaatacgcaaagtcccacagcatcccagaggtcaaggatacctaccaaggtaactaactcagcacatgtctctcaaaggacctcttcttcatgatacaacccgatattcaagaagatccatttcatgactgtacccccatatgcaagcaagctcaaactaacccctgacagagatcctcgacgaccccaacatcgacgccgtcttcatccccctccccaacggcctacactttgaatgggccgtccgcgccatccgcgccggcaagcacgtcctcctcgagaagccctccgtgtccaactccaccgaggccgaaatcctcttcaacctgcccgagctggacgcgcccaacgcgccggtcctcctcgaggcctttcacagccgcttctacccctcgtgggccctcttccgctccctcgtcgagccctccgagattgagcacgtcgagacccgctccatgatcccctggtgggccagcagcaaggaccagattcacttcaactacgcgctgtctgggggctccatcatggccatgggcacgtacaacctcgccgccctgcgcctgctctttggcgagagccccgaggagtgcctcagctgcgacgtcaaggcgtacaccgacggcatccacgacaagtgcgactacgagttcaaggccacgttccggttccccggcggccgcaccggcgtcgcctccagcaccctcatgggcgagaccatcatcaagccctcgtgggtcaccgtcactacgaagcaggtgcccttcccgaacgtcaacctcccggccggccagcaacagttccaacggcgcgagctcacgcttcaggggcttgtccacggcgtcttctggcaccgtatcgacatcaaagagatgaacgagatccgctccaaggacggcagcgtcgtcaaggcctggaccaaggcgacgtcccgcaaggcctacacctggaaggaggccggaggcgagttcgccgatctgccgggcgaggcgcactggatgtcgtataggcaccagctggagcagtttgtcaacaggatcaaaggccgcaagacgcagcattgggtcgacagggaggactccattgctcagatgaagatggttgacatggcgtatgagaggagtggcttggggcctcggcctgcgagttcctttcggtga

SEQ ID NO: 123 - protein, 406 aa, Trichoderma reesei QM6a
MALVSRIWGCFNPPTPPKSSDAIRFGVLGAAGIAPLALFNPAKSHPEVIIQAISARDRKKAEEYAKSHSIPEVKDTYQEILDDPNIDAVFIPLPNGLHFEWAVRAIRAGKHVLLEKPSVSNSTEAEILFNLPELDAPNAPVLLEAFHSRFYPSWALFRSLVEPSEIEHVETRSMIPWWASSKDQIHFNYALSGGSIMAMGTYNLAALRLLFGESPEECLSCDVKAYTDGIHDKCDYEFKATFRFPGGRTGVASSTLMGETIIKPSWVTVTTKQVPFPNVNLPAGQQQFQRRELTLQGLVHGVFWHRIDIKEMNEIRSKDGSVVKAWTKATSRKAYTWKEAGGEFADLPGEAHWMSYRHQLEQFVNRIKGRKTQHWVDREDSIAQMKMVDMAYERSGLGPRPASSFR

SEQ ID NO: 124 - DNA, 954 bp, Trichoderma reesei QM6a
  CDS (1)..(951)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR49047.1 (47930)
  ref <309>: DATABASE ENTRY DATE: 2006-10-18
atgaattccatcaagcaagccgtcgagtccgctcgatcgaggacctcggatgtcatgaacagcgccaagaggagcgaagcggccaacaaggcctccgacatcatccacaatcccttcatgcgcgcagctctgcccttcatcaatggaggcatcagtggcatggtggccacgtcggtgatccagccggtcgacatggtcaaggtccgcatccagcttgctggtgagggcacctctgggggacccaagcccacgccgctgtctgtcactcggcagatcatctcgagcggaaaattcctcgacctgtacaccggcctctccgccggcctcctccgacaggctgtatacacaaccgctcgcctgggcttcttcgacaccttcatggccaagctgacggagcgggcaaaggctcaggatcgccagatcggctttgcagaacgagccacggctggattggccgccggcggtcttgcagccatgattggcaacccggcagacctggccctcatccggatgcagagcgacggcttgaagcctcttgccgagcgcaaaaactacaagtcggttgttgatgcactggggtccatcgccaagggtgaaggcatcggcgctctctgggctggcgctgcgccgactgttgtccgtgccatggccctcaactttggacagctggccttcttcagcgaagccaaggcacagctgaagcagcacacggacttgtctgcccaggctcagaccctgagtgccagcgccattgccggattcttcgccagtttcttcagtctgccgttcgacttcgtcaagaccaggctgcagaagcagtcgaggggacctgatggcaagcttccgtacacgagcatggccgattgttttgccaaggtggccaagcaggaaggtgtcatgagattctaccgaggattcggaacgtactacgtccgcattgcgccccatgcgtaa

SEQ ID NO: 125 - protein, 317 aa, Trichoderma reesei QM6a
MNSIKQAVESARSRTSDVMNSAKRSEAANKASDIIHNPFMRAALPFINGGISGMVATSVIQPVDMVKVRIQLAGEGTSGGPKPTPLSVTRQIISSGKFLDLYTGLSAGLLRQAVYTTARLGFFDTFMAKLTERAKAQDRQIGFAERATAGLAAGGLAAMIGNPADLALIRMQSDGLKPLAERKNYKSVVDALGSIAKGEGIGALWAGAAPTVVRAMALNFGQLAFFSEAKAQLKQHTDLSAQAQTLSASAIAGFFASFFSLPFDFVKTRLQKQSRGPDGKLPYTSMADCFAKVAKQEGVMRFYRGFGTYYVRIAPHA

SEQ ID NO: 126 - DNA, 1586 bp, Trichoderma reesei QM6a
  CDS (1)..(456)
  CDS (564)..(1583)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45985.1 (110423)
  ref <309>: DATABASE ENTRY DATE: 2006-10-18
atgccaccacagctccgggccttcggcggtgggcccggcgtcggcgcgcctttccaccaagccggcttcccttcccacggccagccacagggaggtcctttgggaaaccagtacctcaatgccaacgcccagctgaacccatttacgcccaacaacatcaactcgttcaacgccgcagccctcaatggcgccgccggcttccccgacacgggcttcggcagccagagcgcgaggatgggcttcgcgcatgggcccaatgccgcggccgcagccctccagcagccgcagcagcagcagcacggcggccaggttcagcacaatgcattgatggatcatcccacaatgcgcagccagcagtccaacaagggcaggatacgcgaagtctggaaacacaatctcgaagaggagatggctgtgctgagagacattattgacaaatacccctatgtagccatggtgagtccttgtttcgacgcattgcgaacccaattgtttgccatgatgctgttgttgtgctgttttggaggatgaatcgtgctgaaactcaaggatgaaattgaaaggacgcggaattccccggtgttgtagcaagacccatgggcggtttcagggggaagagcgactaccactaccagtgtctgcggaccaacgtggacatgctcaaggtcatccagattggcatcaccttgttcaacgaagatggagagacaccaccagcgcggcccggccctgagctgggcctcagcccggcaacaaggcggcacattggccaagggccgtttccgtattcatggcagttcaacttcaagttctccctgaaagacgacatgtacaatgagaaatcgatcgagtcccttcagcaggccggcatcgactttaacctgctcgagcgtgacggaattgacccccatcagtttgcctccctgctgataccgtccggcctagtatgcttcgacaatgtccggtggatatccttccacggcggctacgactttggctacctgacaaagctgctcatctgcacgcctctgccaaacgacgaggtggactttgaccacaagatgaagctatactttcccaagacgtacgacgtgaagcacctgatgaagcacgccatcaggcttcacaactcggggatgctcacgcccagcgaccccggcaccgcggagatattgcaaaagtttgagcacaagtcgggtctggagaacattgccgagactctcaagattaagcgcatcggctccgctcaccaggcgggctcggactcgcttctcacgggcaaggtcttcttccagatgcgagacaggatattcaacggcgagatccccgacgatcatctgggcaaggtctggggtctgggcatccccgacattggcctgcccatgtccatgatgggccagggcggcgaccagaacggcgggcagaacggcaacacgcccagcacgcccaacacgggcaccgcgcatctggcgacgaccccggcgcagaaccacaacacaaacgggctgcccaacatggggcccatgaccccgggcggaggaggcggcgtctttggtaactttgcatttggagggaacggcagatag

SEQ ID NO: 127 - protein, 492 aa, Trichoderma reesei QM6a
MPPQLRAFGGGPGVGAPFHQAGFPSHGQPQGGPLGNQYLNANAQLNPFTPNNINSFNAAALNGAAGFPDTGFGSQSARMGFAHGPNAAAAALQQPQQQQHGGQVQHNALMDHPTMRSQQSNKGRIREVWKHNLEEEMAVLRDIIDKYPYVAMDAEFPGVVARPMGGFRGKSDYHYQCLRTNVDMLKVIQIGITLFNEDGETPPARPGPELGLSPATRRHIGQGPFPYSWQFNFKFSLKDDMYNEKSIESLQQAGIDFNLLERDGIDPHQFASLLIPSGLVCFDNVRWISFHGGYDFGYLTKLLICTPLPNDEVDFDHKMKLYFPKTYDVKHLMKHAIRLHNSGMLTPSDPGTAEILQKFEHKSGLENIAETLKIKRIGSAHQAGSDSLLTGKVFFQMRDRIFNGEIPDDHLGKVWGLGIPDIGLPMSMMGQGGDQNGGQNGNTPSTPNTGTAHLATTPAQNHNTNGLPNMGPMTPGGGGGVFGNFAFGGNGR

SEQ ID NO: 128 - DNA, 3824 bp, Trichoderma reesei QM6a
  CDS (1)..(46)
  CDS (89)..(352)
  CDS (479)..(817)
  CDS (943)..(3821)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45928.1 (110648)
  ref <309>: DATABASE ENTRY DATE: 2006-10-18
atgggcacaatcaaccagacaatgagcgaccaggacggcgatgtcggtatgcagagactggacggaggaatgcctacaccgacaccagatatggcccccgttgctcctcctctccacacagccatgttcgaggccatcgacttaatgaagaccaggattcggcaactcgaggaaggcaacgtatcagccacgcccaccgagagggctcgatatggcatgcttcttggagcctgtcacaacatggacccggtcttccttatcctccaccaacagtactgctgttggatgatagacaggagaacagcatatgcccgcttccccatccagcccactgtcattgatgtagcctttggtgagctatataacctattccaagatggtgagcgactgagtcctccgcatcgtctatggtgctcgaggtacccggggttcagcgacgatgtggttggtctcgatcgcgtgtatagccagatcaaagacttcatcaccgtgtttgccataaagtggccgcacgccctagcagccattcagtccaagaaggtgccccttatggcattccagatccgtgactggttcttgtgtacgtcgccaaccattgccaacacgctgttcacgtacatccgaagggtaatcggggtgcctaacgggccactgggagtcgagatcaaccatctcttcaacatggacaactgccaggagcgcgcctttgaagagcagaaagtgtcgccggaggaaatggcgggtatccgcagcaccatgttgaggagttacctggctgtcgtgcagaaggctcgaatacaacaagccagtctcgcaggttggtcaaggctctttctaatggattcttgtactttctgaattttgttattcggggctaactggtgaatggggtgtttgctctatatatagtcgtgccagctgccaactctcaacgagtgccagggcatgtgccagccagtgccagtgccatgaatatcaacaacgacaacaataacaacaacacaaacacagacgcaggcgcagacgcaaacgcaaacacaaacacaaacacaatcggaaatcacaactacgacaccaacaacaacgccccacgtgtcacttcgagggcttctcaccagccgcagctcacccgtcctcttcttcaagaccttgcgcaccaaacacaggctcccatggttcgcccccagccacaccaagctcttccacatgcctcctcccaagcctcccaagcctcccctcagaacgctcagcctgcggctcttcctgcgcgaccaccgtctcaacctgcagcgagttccgaaggtcgactgcggccgtgtggcctacaggacccaacaggctcccctgacttcccacgaaatttgcaggctacgagggttccagggccaccggggcccccggccttggaccaagagaacttcctgcctccaatgatattgccacgaggcgaatcactgccacctgcagaacgacggccgaggcagcaccagagtcatgatacctctcatccttctccatctctgccttctcctccccagccgcagcagtctcctcctcctttgtatccccagcacccttctcttccaccgcgtcctcttgtttctactcatccttcccctcctcttccgcccccttctcttccgccccctccccgtccatatactcctcgcacccaacatccttctcctcccccacagccacaagagccaagtcgcccccagtactcttctccagcgtctctccttcagcggtatccttcgccccagcttccccaagatgctcaacatccacaaatacatcatcagaatcagcaacgacccccatatccccagcgcgttcaataccctcagtatccgcagcatcctcagtattcgcagcactctcggcaacctcagcttccccagcacatgcagttacaataccttcggcaatctcagagtcaccagcagtttatgaatccccaacatccgcagcatcttcagtatcttcagtacgttcgcaatgctcagcagcagcaactgcgaaacgcccagcagcatcctactcaacaccagcagcatcctactcaacaccagcagcatcctactcaacaccagcagcatcctactcaacaccagcagcatcctactcaacaccaacagcaaactcagcagcagcaaaatcatggcactcacggcaatgagagtcacctccgtggcccaaacccccatgcaatgcaaaacccggctttcacgccgctgcagcagaatcattcgctacccccatcaggacaaactcaacaacacggtgtgcagggcgatagcaggcagcatcaccagccatcgcctatgctgtccaacgggccgcctccgctcctatcttacccacatcatcagaacacgccgccgacgccgacgctgcagactagtcaggtttcccaggcccttcaaagttctggaggaccccaaggccgtcaaggacagggtcatgtgcattcaagccctcagcttacgatggtccgtcagccttaccgccgctcgggcatgccagtccaagtgctgcaggatcccggcctgcactatgtgcaagcgcaaccgcatactcgagatccccatctagctctcccatcacatcccggtccaacaagcagccggtcaattccgcatttcacaacttacccccttcccccgtatgaacatccctgcagcccgcatcatattacatcgctagaagcaagccttcacttgacgggtttgcgtagccctcgaagaatctcttctggtccaggacaaggcgcgcaaaagcgtctgactcgttactatcagttcgtctcgaggtttgctgtggaaccaagcgaggttcctccgcagatgggggtcgctgtcttcgagtttgatgtgacccaagaagagacagaccgtctctccataactagccgaccacctgcctcgccccttgatgatttatacatgacccagttgcctgtgagccggcacttcaaccactctcttcgataccgcctccgcatgtgcttcacgcgcaagaatgagggacttgcggctcttgatatagcttcatggagtcgacgcgcgacttactggccgccgcatatctttgtctccgtcaatgagaagatccttcatgtccgccgcaagcagcattttcatcatgacttgccgctcgaactcaccgactcgttgtccaggggaaagaataagatcaaggtcagcctgccactattccctggaaacctcatacaggacattgcctacttcatggctgtcgagcgcatcgtcacgctggatcacgataccgtctgggacatggtgacgtctgggccccatgtcacggtagaagtggccaagaaggagatctgcaggcgactcaaaggattggacacagatgagatcatcattgaaagcgacgccatagcggtctcggtcacagacttatacagttccacgctaaacaaaatgcccgtgcgaggccgcaaatgcctgcatctcgagtgtttcgacttaggaacctggctgctttctcgcccaagcaagccaccgcaaggtctaggcgagccaactatggtagactgctgggcctgccctatatgtgggatggatgcgcggccctgcaacctccaggtagatgatttcttcgccgatgtagcaaaggagctcttggctagcggcaacacgggcgtcaagaagattgaggtgcttgcggacggcagctggacggcaatagaagaggtcaatgaaggagaagaattgtcgggctctgagggtgcccagcagagtcctccgagccgagtgaagatacaggaggaaacgccagatacactggactga

SEQ ID NO: 129 - protein, 1176 aa, Trichoderma reesei QM6a
MGTINQTMSDQDGDVDMAPVAPPLHTAMFEAIDLMKTRIRQLEEGNVSATPTERARYGMLLGACHNMDPVFLILHQQYCCWMIDRRTAYARFPIQPTVIDVAFDFITVFAIKWPHALAAIQSKKVPLMAFQIRDWFLCTSPTIANTLFTYIRRVIGVPNGPLGVEINHLFNMDNCQERAFEEQKVSPEEMAGIRSTMLRSYLAVVQKARIQQASLAGHVPASASAMNINNDNNNNNTNTDAGADANANTNTNTIGNHNYDTNNNAPRVTSRASHQPQLTRPLLQDLAHQTQAPMVRPQPHQALPHASSQASQASPQNAQPAALPARPPSQPAASSEGRLRPCGLQDPTGSPDFPRNLQATRVPGPPGPPALDQENFLPPMILPRGESLPPAERRPRQHQSHDTSHPSPSLPSPPQPQQSPPPLYPQHPSLPPRPLVSTHPSPPLPPPSLPPPPRPYTPRTQHPSPPPQPQEPSRPQYSSPASLLQRYPSPQLPQDAQHPQIHHQNQQRPPYPQRVQYPQYPQHPQYSQHSRQPQLPQHMQLQYLRQSQSHQQFMNPQHPQHLQYLQYVRNAQQQQLRNAQQHPTQHQQHPTQHQQHPTQHQQHPTQHQQHPTQHQQQTQQQQNHGTHGNESHLRGPNPHAMQNPAFTPLQQNHSLPPSGQTQQHGVQGDSRQHHQPSPMLSNGPPPLLSYPHHQNTPPTPTLQTSQVSQALQSSGGPQGRQGQGHVHSSPQLTMVRQPYRRSGMPVQVLQDPGLHYVQAQPHTRDPHLALPSHPGPTSSRSIPHFTTYPLPPYEHPCSPHHITSLEASLHLTGLRSPRRISSGPGQGAQKRLTRYYQFVSRFAVEPSEVPPQMGVAVFEFDVTQEETDRLSITSRPPASPLDDLYMTQLPVSRHFNHSLRYRLRMCFTRKNEGLAALDIASWSRRATYWPPHIFVSVNEKILHVRRKQHFHHDLPLELTDSLSRGKNKIKVSLPLFPGNLIQDIAYFMAVERIVTLDHDTVWDMVTSGPHVTVEVAKKEICRRLKGLDTDEIIIESDAIAVSVTDLYSSTLNKMPVRGRKCLHLECFDLGTWLLSRPSKPPQGLGEPTMVDCWACPICGMDARPCNLQVDDFFADVAKELLASGNTGVKKIEVLADGSWTAIEEVNEGEELSGSEGAQQSPPSRVKIQEETPDTLD

SEQ ID NO: 130 - DNA, 1475 bp, Trichoderma reesei QM6a
  CDS (1)..(243)
  CDS (375)..(1472)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45930.1 (51217)
  ref <309>: DATABASE ENTRY DATE: 2006-10-18
atggccaccgcctggctgcgccgagtgcggcgcctcaacgcccacaacctgacgaccttccgggatgcgcccctggccgagatatccggctcgctgggcgacttgggcacgctgctgcccctgatgattgccctcgcggccaaggggtacattgacctgggctcgacgctggtcttttcgggcttcttcaatgtcctcaccggcgtcgtctttggcattcccttgcctgtgcagcccatgaaggtatgtatgaacgagtgagatgcatgtacggtgtggagcgagctcgactcccgcagtctctaagatcttttagccatcgccatcgccaaatctacgacttcatgtccatgctgatcgtcttcgtggtccaggccatcgccgcagctgccatctcggcacgcgagaatccctccatgggcgtcgtcgtcgctgccgggcaatgggtcggcgcagcagtcctcgtcatgagcatcacgggcctgctgcggagggccgtggcctttgtgcccatccccgtcgtcaagggcatccaactcggggcgggactctccctcatcatcggcgctggctcgtcgctgctgcagcctcttggctggatccatcccgtgctggacaaccgcttctgggccctggcggccttcctcgtcctcatcctgacgcagaacatgcctcgcttcccgtacgccctgagcttcttcctcctatctctggtgctggccctcgttcaggtgtcactctctcaccagagcttgccttggttccacgtctggcaaccacactttgtcctcccctcgtggatcggtaacggagacgccccggcgttgtggatggcgatagggcagcttccactgacgactctaaactccatcatcgcggtgagcgcgctggccgccgatctgctgcccgacctgcccacaccctctgtcacctcgataggactgagcgtggcactcatgaacctcaccggaacatggttcggagccatgccggtctgccacggcgccggaggactggccgcccagttccgcttcggcgcacgcagcggagccagcgtgatcctgctgggcctcttgaagattgctttggggctcctgtttggggagacgctcgtcaacttgctgaagcagtacccaaagggcttgctcggcgtcatggtggtggctgctgggctggagctggccaaggttggccacacgctgaaccagggtgctcctgatctgtggcacgtgtctgttggccagggccgtacggagggcttgagggagcatcggcatctctcagacgaagaacgcctggagcgatggacggtcatgctggtgacgacagctggccttctcgcgttcaggaacgacgcggttggcttcctggccggcatgctttgtcacagctcgtatcggctgtctgagaggctcctgagctggaagaatcgccggtctattctttcaagcgagcgggcgccattactgcgatga

SEQ ID NO: 131 - protein, 447 aa, Trichoderma reesei QM6a
MATAWLRRVRRLNAHNLTTFRDAPLAEISGSLGDLGTLLPLMIALAAKGYIDLGSTLVFSGFFNVLTGVVFGIPLPVQPMKAIAAAAISARENPSMGVVVAAGQWVGAAVLVMSITGLLRRAVAFVPIPVVKGIQLGAGLSLIIGAGSSLLQPLGWIHPVLDNRFWALAAFLVLILTQNMPRFPYALSFFLLSLVLALVQVSLSHQSLPWFHVWQPHFVLPSWIGNGDAPALWMAIGQLPLTTLNSIIAVSALAADLLPDLPTPSVTSIGLSVALMNLTGTWFGAMPVCHGAGGLAAQFRFGARSGASVILLGLLKIALGLLFGETLVNLLKQYPKGLLGVMVVAAGLELAKVGHTLNQGAPDLWHVSVGQGRTEGLREHRHLSDEERLERWTVMLVTTAGLLAFRNDAVGFLAGMLCHSSYRLSERLLSWKNRRSILSSERAPLLR

SEQ ID NO: 132 - DNA, 1590 bp, Trichoderma reesei QM6a
  CDS (1)..(835)
  CDS (905)..(1587)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45848.1 (67470)
  ref <309>: DATABASE ENTRY DATE: 2006-10-18
atgtcgtcagcagccggcagcgagaagtcctgggattgcctgcccccagagatccggcaccagatcttgcagtccttgctggggcaagacggttctcacctggctccctatgccgctgtgtcacgagaatggcaagcagtcattgagccgcacacctttgctcgaatcaagctgacgccgtcgcgcatcgaagagtctgaatccatgctccaccgcaacaaggctcacgtacgatatatatggttgtgcttggaactcatggaatacgactgctatatgtgcgcgcccatggatccattactaagaggattccgcgacacggacagcttcaaggtcatgacaacattacttaatgcctttacagttctcagcaaatgggattcacgcggctgcctgcagctggacatcagcatctactcccccagcgattcagagcactggttcaaatatctgacgttcgaacccgatgtatctttcgaagagcgcgaccgacgtcgacgcgtggagcgagcgatacggtacagatgtgaggactggaatcacggttggcgtggtggtcgtcgacgtttcgccccagacagatgggccgtgcacaagatattcaacgatatcatggacaacgtaccctttttggaagacgctccagaacaccaatactggcagctgctgcctttggtcccagtggtgacgagtgtgcttcttcgtcagcagaaccgccgacgatggaatccgacggcgctggcgtgcatatttgcccggcttccccgtcttggggaggttcattacgaaccttggagagaatgggaccatgcacaacagatacagatggatgagtgtcagtctgccatacttgttgtcatcctgcccgagcactgaaaccatactgaactttatcaacctgcaggcatgcgatcgctcacggagtccctggcttctagccaggtacgacgactcatactatttgagacttcatgcccgcagtacttgcttgacttcccgcatttcgatgctgaccgaggctcgaccgttgtcgtaagccaggccatcgccagggccagcctcatgctcgagcacctctcagcatcattcatggtagacgctagcgagttctttgccgccctcgatccttcctggcgatggcgcaacttgacatggcttgcgctgacttcacggttgctcgctcccgatcaggacgttgatacgatggatggcatgcttgaggcagcagcggccgcggccatgaccatgagaaagctggagacaatggagatttggaatggatcagagggactggcaatgctcttcagatacaagcgagccccagcaagggcaatggctgagattacaatcaggggaacctgggagttgtccttgcatcctggagttgtcaatgcctggcaagccgccgcagggaggcattgttgctacggatgcacaattgagagggagtcgctggatgctgctgctgtcacctcgtacgctgatgcaatacaccttctgaggctttcccacccggtgattcggcccatttcgctggagcagattcggatggagcagaggattcgagatggggtgtttagcgtgagatga

SEQ ID NO: 133 - protein, 506 aa, Trichoderma reesei QM6a
MSSAAGSEKSWDCLPPEIRHQILQSLLGQDGSHLAPYAAVSREWQAVIEPHTFARIKLTPSRIEESESMLHRNKAHVRYIWLCLELMEYDCYMCAPMDPLLRGFRDTDSFKVMTTLLNAFTVLSKWDSRGCLQLDISIYSPSDSEHWFKYLTFEPDVSFEERDRRRRVERAIRYRCEDWNHGWRGGRRRFAPDRWAVHKIFNDIMDNVPFLEDAPEHQYWQLLPLVPVVTSVLLRQQNRRRWNPTALACIFARLPRLGEVHYEPWREWDHAQQIQMDECMRSLTESLASSQVRRLILFETSCPQYLLDFPHFDADRGSTVVVSQAIARASLMLEHLSASFMVDASEFFAALDPSWRWRNLTWLALTSRLLAPDQDVDTMDGMLEAAAAAAMTMRKLETMEIWNGSEGLAMLFRYKRAPARAMAEITIRGTWELSLHPGVVNAWQAAAGRHCCYGCTIERESLDAAAVTSYADAIHLLRLSHPVIRPISLEQIRMEQRIRDGVFSVR

SEQ ID NO: 134 - DNA, 5137 bp, Trichoderma reesei QM6a
  CDS (1)..(84)
  CDS (220)..(325)
  CDS (402)..(527)
  CDS (681)..(915)
  CDS (1006)..(4210)
  CDS (4379)..(5134)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45918.1 (67350)
  ref <309>: DATABASE ENTRY DATE: 2006-10-18
atgccgtccgccgcggatctcaaatacttcatcccgtccgctgccacggcgtccatcttcctctatgcccagggaccaacgatagtctgttgccatcacgacacgctcaccatcgaccggaggttctcacgccatgtcgacgatgtccagctgcttgccgtggataaccagagcgacatgggcgctggccggttcgtcgtgagctatgacgctggccagactgccattgtgtgggatctaatgacgggcgatgagatttcgcgtttcgtttcgtacgagacgctcacagtcgccgcttggatgcggaatgggaacgttgctttcggtgagcggagccagagatgccccccctcctctccttaagctggtgacatgaggtggctaacggattgggcttccaggcaacacacagggaaacatcatcatgtttgaacctactacatccgagcatatctcggctcggacgctagaccagattgcagtgacagcattagccccttcgtctgactgccggacctttgccattggttaagttggtgttcgaccatgaatcgagaagtctgtcgcgaatgtgccacggcgtactgattccatccgatgtagctaccagaacggatctctcttggtcgcaactctgcagcctcggttcaccatcttacacaacctgacgacctcgagagggccatcgcccattgtcaccctcgcctggcacgcgtcctcctcgaggcagaaatcagacatgctggccgtgcagacgcacgatggcgacctgcgggtctggagtgtggccaagtcgtacagcgccgaagatcccgccaaggtcgtcagggtgctccgcaggaacgagaacttcctggctgggcccaattggatggggtggtccaagaacggccgcatcatccaatactcggactcgtaagtcccctatcaagtggacacagcctaagcgcgcggcctcccgcttctgctggtttggttttttgttgtgctgacctcgttgtgcagggaaacgttttcgtgggacgtgagaaccaaacatgtcacaaaggactccatcccgacccttgagcatgttaaaggcctggccgtctatggcccaggagccagtctcttcacccttggaccgaacaacaccgtgcagcagtttgacctcaactccccagccatcatggtggcaaacgtgcagcaccccgcgggcgtccttccgccatctccacccacctccgaggagacagggggcaggtcggtgcactctgccacgaccattcatacctcggaatccgagtcgagctctgtccccctcgagatgggcatctctgaaagcgatgacgaccacctatctcctttccagcggttagcaaagcgcaatgcccccgaagccaggcacgaggtgtacgatacaggcagcgcggcctctagccagagcggcgtgtcatccttgtcaaagtcttcggccagctctcgtacgcctggcaggcaggccagctccctcaggtcgcggggaatgacggaggggacatacatctccgctggttcatccatgaaaacttcgacagtcggccagcgcgaggcggacaactactccatgggatacacactccctagcaccagcggcccatcattggcgtcgtcccggtccaggcatcggccctctcgcctcagacacgaagtaccgaggagtcctgacgaggccaacgtgcaggatctgttcaaatacactcgctcgcggctcagcgacctcccgtacaagcacccgatgccaacgcaacgatctcatcctaccaatgacgatttgcgccgacagatgctcagcactatctttggctggaacaaggaagtagaagacctcattcgagacgagatgagtcgctatcccgcagggtcggcgaaccgaatcttgctagccaagtggctgggcgacattgacgcagacatcatggccgcgggttcccagaacatgacttcccaagactggatgctgctggcactgagcggcattggcggccaggcatcccagcacaagctcggccgggtctatgtccagcgcctgctagagaatggcgatgtccatgttgcggtgacgattatgcttgggatgggcgactataacgatgccattgaggtctacatctcgcacaagcggtatatggaggccctcattctcacctgcgtggcttttcccagcgtctgggagcgtcaagctgccattgtgcgcaaatggggcgagtgggcggtcaagcatggccagcagcaactggcaattcgttgctttgcctgtaccgaccaggagtcctcggagccctggacctctccatcggctgcccagctcaacttccaaaacatcaccccgagcatccccgaggtgctgagccctccgctgtcgcccccgggcatccagaggggcccccagcgcagcgtcgccaaggcatcggcactgaagctgattacgtcctttggagatcccacccaaaaggccaagttctactcgcaggctgacggcggccagacaccgattgcagctggagtgacgcccattgccgagtcggccatctctccgggaggcgcctatgatcccgcgactgcgttcctccggccgtcgggcaacagcaggttcaacacgccaacgtcagcccgccctatcggtcagggcttcagccgcggacggttgccctccatcggggaagccaacaagcccctggataacattgcaagcatcgtggacgcaccccagaaacggccgagccattctcgcaagtcgtccgcccctcaagataacatggcgaccgggctcgccatgcagcgcgctgctacggccagcccaatgatgatgagggaccagtaccagcgcgccgtgcaagggtacggaggagagcgaccgccgtctcccgaccataacatcatgagcaggctgcaagaagtccattcggcacagcgaaacggctcccgtgaccggattcctgctcacctcagcctgcagctgcagacgatgcagccgccatcaatggatgcaatgtctcctgagcaatctggcgcctcatccgctcgcttccactggccgtctcgtcgccgcggtactggccctagttccgcatcagtggcaggttccatgacatccacctccagcgctggtcggagtcacaaatcgaacgctcgacaaagggatgattacatccatagcctggaagcggctcagcactattccaggagagctggaagtcggaccggaagcaaggaacggacacgagacgcgtccaccggccgccacgccagccgagagcgacgaaccaagtcgcgcgacccttcggaagaccgcggtagggcttcagccagatcctggacaaggccaaagcgatcgcccacatccccagttccaatgtcccccgaagacttggccatgctgagcaaccggacattcgacaactccgtggaacccctcacgattcgaaaggcgagcgtggcgaaaggcaagaccagcgggcggacatccagccgcggaaggggtggatcagtaccgcggtcaccgccgtccccggtgccgctgtcggcaacagccctgcattatcagggatcggaggacgaggaggactttagagcagccatgcgggcgcaggaagagttcagggccaagcacagccgcagcgtcggccacaacgtcaattctcccgccgtaagccggcgtgagcattcggaaagccgacgaaaggaagcgactgagactcgagaggctgcacccgtggtcttgagccagacagtatatggacgagccgcttccaccgagcacgccggcgatctgaagaagatgaaggacgagagacagcggaagaaggaacaggctgcgcgagagctagaagagcgtaggaagtctctggccaagcgacagctcggtccccgaattccccatccaagccagatctctcccgggagaccgccggttctggtagaggccgacgacgaaaagctgccggatgatctgccgccgcgctctgcaacggagcctccgagagcggcggagccgccgaggagcatgtatgctcagaacaggccgcagattggcctgcctgccactcccaaggcgatgaggctcattatccggtctgacgagaatcagtacgaggatctccctgctccgccggtgccggcgacgttttctcaaaagtattcgccgcagaactcaccccagtactctccaaaatacacgttgggcagtagtgtttatggagaggagcagaagcagcagcagcagggacagcagcagcagcaacaacgacaacaacaacagcagcagcaacaacaacagcagcagcaacaacaacagcagcagcaacagcaacagcagcagcagcagcaacaacaacaactctttcagcagaaagaggaggagccgccgttgacactgctgccatcgactgtctatcagctgccgtccactgtctaccaaccgccgtctcgccccatgattccgcgaagcatgtcggcaccgatccctgatgagccacctcacgcaattcgatacgggagaaagtcgagtgctaacgagggcagaggcctcgacgatattgtagagacggagtggcgtcgacaagtgaacaacctggtgccgcctccaccaccacctcccccttcggctcccctgactttcctcaaggagctgcagcatctagccgtgccgccccctcctccgccagcaccgctgccacacgtgcgacgccagccgcccgtggctggaacactggcctcgggcatgattgagattgtcatggacgacgacgaggcagaagagcccatgtcggctgctcccaacgacggcaaggtgccggtgctcgcccagcccgaaccccctgtcaagggccacaaccgcggtcgcagcctcggggagggcagcctttccgggcgtaggaccaaggcgacggagcgcctccgctcgggcagccgcagccgcaaaggatccatcggcgtcatgtcgccccctctcgagatgtacggcggtgagggcaatgccaactcgctgaaccagctcaggtcgcccgtggcgggcaatcctccgcctgtgctgtatgaccgggacgccattcgatcgcccattgaggggcatggccgcaagatgtcgatggggctgcacgagaacggcatgttttag

SEQ ID NO: 135 - protein, 1504 aa, Trichoderma reesei QM6a
MPSAADLKYFIPSAATASIFLYAQGPTITAIVWDLMTGDEISRFVSYETLTVAAWMRNGNVAFGNTQGNIIMFEPTTSEHISARTLDQIAVTALAPSSDCRTFAIGPSPIVTLAWHASSSRQKSDMLAVQTHDGDLRVWSVAKSYSAEDPAKVVRVLRRNENFLAGPNWMGWSKNGRIIQYSDSETFSWDVRTKHVTKDSIPTLEHVKGLAVYGPGASLFTLGPNNTVQQFDLNSPAIMVANVQHPAGVLPPSPPTSEETGGRSVHSATTIHTSESESSSVPLEMGISESDDDHLSPFQRLAKRNAPEARHEVYDTGSAASSQSGVSSLSKSSASSRTPGRQASSLRSRGMTEGTYISAGSSMKTSTVGQREADNYSMGYTLPSTSGPSLASSRSRHRPSRLRHEVPRSPDEANVQDLFKYTRSRLSDLPYKHPMPTQRSHPTNDDLRRQMLSTIFGWNKEVEDLIRDEMSRYPAGSANRILLAKWLGDIDADIMAAGSQNMTSQDWMLLALSGIGGQASQHKLGRVYVQRLLENGDVHVAVTIMLGMGDYNDAIEVYISHKRYMEALILTCVAFPSVWERQAAIVRKWGEWAVKHGQQQLAIRCFACTDQESSEPWTSPSAAQLNFQNITPSIPEVLSPPLSPPGIQRGPQRSVAKASALKLITSFGDPTQKAKFYSQADGGQTPIAAGVTPIAESAISPGGAYDPATAFLRPSGNSRFNTPTSARPIGQGFSRGRLPSIGEANKPLDNIASIVDAPQKRPSHSRKSSAPQDNMATGLAMQRAATASPMMMRDQYQRAVQGYGGERPPSPDHNIMSRLQEVHSAQRNGSRDRIPAHLSLQLQTMQPPSMDAMSPEQSGASSARFHWPSRRRGTGPSSASVAGSMTSTSSAGRSHKSNARQRDDYIHSLEAAQHYSRRAGSRTGSKERTRDASTGRHASRERRTKSRDPSEDRGRASARSWTRPKRSPTSPVPMSPEDLAMLSNRTFDNSVEPLTIRKASVAKGKTSGRTSSRGRGGSVPRSPPSPVPLSATALHYQGSEDEEDFRAAMRAQEEFRAKHSRSVGHNVNSPAVSRREHSESRRKEATETREAAPVVLSQTVYGRAASTEHAGDLKKMKDERQRKKEQAARELEERRKSLAKRQLGPRIPHPSQISPGRPPVLVEADDEKLPDDLPPRSATEPPRAAEPPRSMYAQNRPQIGLPATPKAMRLIIRSDENQYEDLPAPPVPATFSQKYSPQNSPQYSPKYTLGSSEPPLTLLPSTVYQLPSTVYQPPSRPMIPRSMSAPIPDEPPHAIRYGRKSSANEGRGLDDIVETEWRRQVNNLVPPPPPPPPSAPLTFLKELQHLAVPPPPPPAPLPHVRRQPPVAGTLASGMIEIVMDDDEAEEPMSAAPNDGKVPVLAQPEPPVKGHNRGRSLGEGSLSGRRTKATERLRSGSRSRKGSIGVMSPPLEMYGGEGNANSLNQLRSPVAGNPPPVLYDRDAIRSPIEGHGRKMSMGLHENGMF

SEQ ID NO: 136 - DNA, 3153 bp, Trichoderma reesei QM6a
  CDS (1)..(3150)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45146.1 (81576)
  ref <309>: DATABASE ENTRY DATE: 2006-10-18
atgtcgtccaaggttgaagaatcctccaccctgccttttggcaagcaggtgcccttgtcggacatctctagcccgacctatgtgacggcccagctgcttgtccagcagatcgcgtacaagctctccgacaagatcttctcctactctcctcccacctttggccttgacgcttctgccaggcagtgggctgctgatgagagcaagaacgttcacggctacgcccccgatgttctgcctctccagactcgaacaggtgccggtgccctcgccctgggctacatcttctcgccagactttgacgtcagcaagcgccatattcctcagaccctgctggctccgtcgggttctcttcagaaccttcgcggaaccctggaccagctctcccttctctacaacctctccagccccttcgtggcccatgtcgctgccgccgactacagcgccgccaacggtctcgtctccgactatgaagttgctttgagactcgctgaagatctcggcttgggcctggttgccagctcctccgtgtacgagacccagcacatgtccatcttttcaacactgctggccagcgttgttcctactcttcacatctacgacggcattcgccttcctagggagactctgcgagtggttgacgctttgagcgagactggcgtggccaacgtgtataacaccctcgtcaaggaggctggcaagttgaaccagcacctggatactgcaggcaaagtcctggagcttctgaaactctttaacgatgagctcggcactgtgtaccagccatttgaataccacggtcacgaaacccctgacgttgtcctggttgcgctgggaagtgtcgagactcaggtcgccaaggagactatcaagaagattgccggggatggagccaaggtcggcgtcatcaatgttcgtgtctaccgacccttcatcgaggaggccttcctcaaggctatccccgcctctgcccgcaccattgcagtgcttggccaggtcaacagcgaagccgctgtgacagacgaggccacacagtcagcgctgtacggcgacgttcttacagccgtcacctttgccggcaagttcgagcagcagcccgaagttttggacatcaagtacactcctgcccaatccctgaccccgcaaggcctggtcaacattctgcacaagatcttcggaaatgacgacgaggccaagcctctgccttctctactgatcaagccccaagaattcacgttttgggaccttgataactccgtgtccgccaagtcagccgccgcccttggcaagttccttgcccaggaagacaccaacaacgttcaggtttttgagacgtacgacaacttcacacagggcggcattgtccgaaccgatgttcgtgcgtccaagtacgagctggaagcgccctactctgtgactgctgccgagaccgtggttgttggtgacgaaaagatcctcaaggatgtcgacgtgctggccaatgttgtccctggtggcaagctgctcatcaagctgccaaactttaacaaggctgatgtcgaaaagcgactgccagccgccgtgcgcaagacaatccgtgaaaagggtcttcgcgtcttcgttttggatcctgccgtctctcccgctttcgagaaggatgcttcagtcgctaagctgctccttgagctcgccttcatgcaagtcgctctgccagaaagccgtcctgaggacttcgccgctctcgtcgaagcacagcctcacctgcaggaggctcgcagcgctcttgaccaggtcctgtccgagcttgaggtgcccgacagctgggcagaggttgagcctgatttcgtccaccccagtctgccaactgacgttcagaccaatgcctttgttcccttcgagaaggaggaggccgaagaggcttggaagctccaagattggcaggttgccgccaagggcctggtctttaaggaggcctatggcacgcagacgacgctgcggcccgaactctcggtcaagacctccaccgtccgggtcaaggagaaccgccgtctgacgccctcagactacgaccgtaacatcttccacattgagttcgatcttggcgactccggtctcacatacaagattggcgaggccctgggcatccacgcggagaatgatgaggagcaggtcaatgctttcatcgagttctacggcctcaaccccgcggagcttgtccaagtgccctctcgcgaggaccccgaggccctcgaggtccgcaccgtgttccaggcgctcacgcaaaacgtcgacatctttggcaagcccccgaagcgcttctacgaggccctgtccgagtttgccaccgacgagactgagaagaagaagctggcggccctgggcggcaacgacggcgccgccgagttcaagcgccgctccgaggtcgacaccgtgacctacgtcgacatcctcgaggagttcagctctgcgcgccccagcttccacgacctcatcaagatcgtcagcccgctcaagcgccgcgagtactccatcgcctcggcgcaggccgtcacgcccaacagtgtctccctcatgattgtcgtcgtcgactgggttgacaccaagggccgcacgcgcgtcggccaggccacgcgctacctcagccgcctgcagcccggcgccgccgtcaccgtctccgtcaagccctccgtcatgaagctgcccaccaaggacacggcgccgctcatcatggccggcctgggaaccggcctggcgcccttccgcgccttcgtgcagtaccgcgccatgcaaaaggcccagggcaaggagattggctccatcctgctgtacctcggctcccgccaccagcgcgaggagtacctgtacggcgaggagtgggaggcctacctcgccgccggcgtcgtcacgctcatcggcagcgccttctcgcgagaccagcccaaaaagatttacatccaggacaggatgcgccagacgctggacagcatcgcccaggcgtacatcaaggagggcggcagcttctacctctgcggtcccacctggcccgtgccggacgtcacggccgtgctcaaggaggccattgccgccgaggcccaggcgtcgggcaagaaggttgaccctaccaaggagattgagaggctgaaggaggagggacgatatgtgctcgaggtatactaa

SEQ ID NO: 137 - protein, 1050 aa, Trichoderma reesei QM6a
MSSKVEESSTLPFGKQVPLSDISSPTYVTAQLLVQQIAYKLSDKIFSYSPPTFGLDASARQWAADESKNVHGYAPDVLPLQTRTGAGALALGYIFSPDFDVSKRHIPQTLLAPSGSLQNLRGTLDQLSLLYNLSSPFVAHVAAADYSAANGLVSDYEVALRLAEDLGLGLVASSSVYETQHMSIFSTLLASVVPTLHIYDGIRLPRETLRVVDALSETGVANVYNTLVKEAGKLNQHLDTAGKVLELLKLFNDELGTVYQPFEYHGHETPDVVLVALGSVETQVAKETIKKIAGDGAKVGVINVRVYRPFIEEAFLKAIPASARTIAVLGQVNSEAAVTDEATQSALYGDVLTAVTFAGKFEQQPEVLDIKYTPAQSLTPQGLVNILHKIFGNDDEAKPLPSLLIKPQEFTFWDLDNSVSAKSAAALGKFLAQEDTNNVQVFETYDNFTQGGIVRTDVRASKYELEAPYSVTAAETVVVGDEKILKDVDVLANVVPGGKLLIKLPNFNKADVEKRLPAAVRKTIREKGLRVFVLDPAVSPAFEKDASVAKLLLELAFMQVALPESRPEDFAALVEAQPHLQEARSALDQVLSELEVPDSWAEVEPDFVHPSLPTDVQTNAFVPFEKEEAEEAWKLQDWQVAAKGLVFKEAYGTQTTLRPELSVKTSTVRVKENRRLTPSDYDRNIFHIEFDLGDSGLTYKIGEALGIHAENDEEQVNAFIEFYGLNPAELVQVPSREDPEALEVRTVFQALTQNVDIFGKPPKRFYEALSEFATDETEKKKLAALGGNDGAAEFKRRSEVDTVTYVDILEEFSSARPSFHDLIKIVSPLKRREYSIASAQAVTPNSVSLMIVVVDWVDTKGRTRVGQATRYLSRLQPGAAVTVSVKPSVMKLPTKDTAPLIMAGLGTGLAPFRAFVQYRAMQKAQGKEIGSILLYLGSRHQREEYLYGEEWEAYLAAGVVTLIGSAFSRDQPKKIYIQDRMRQTLDSIAQAYIKEGGSFYLCGPTWPVPDVTAVLKEAIAAEAQASGKKVDPTKEIERLKEEGRYVLEVY

SEQ ID NO: 138 - DNA, 1824 bp, Trichoderma reesei QM6a
  CDS (1)..(455)
  CDS (524)..(578)
  CDS (633)..(692)
  CDS (750)..(1278)
  CDS (1331)..(1638)
  CDS (1732)..(1821)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45155.1 (81593)
  ref <309>: DATABASE ENTRY DATE: 2006-10-18
atgatgctcatcaagctcggccgctcgccagacgaagtcatcaccgtgtctcccgccgacgacgcccgcatcctccgccgtatcgacctcgccctgcttccgctcatgctttccgtatacttcttgcaggctctcgacaaagctacgctgtcgtatgcctccatcttcggcctcatcgacgacacggatctggtgggcgacgagttctcgtggctggggagcattgtttacctcgcccagctcctcatgcagctgcccttggcgtgggcgttggtcaagctgccaattggtaaattcacaagtgccatggtctttgcttggggaataaccttgacgtgcatgacatgggcgcacaactttgggcagctcatgacagctcgtttcttcctgggtgcctttgaagcttgcgtggggccggcctttgttgccataacgcagatgtggtggagacgcaggcatgttgttatcgccaggccactcagaccagattctggagaatactaacacgttttgtgccggatagggaacaaacgctgaggatcgggtcgtggtattgtatgaacggtctgacctgggtggtgagttgctcctgacttttcaaattattgtacatgttactgaccgatatgtagtttggaagcctcatcacatatgggcttgcaagcatagattcacatctcaagccttaccaggttagtatggcacatgttggccatcacctggagtatctatgctgacaatggtcgaagatcatctttctcttctttggcgttgtcacggtcgcagtatccggagccatgttcttctggatgccagactcgcctactgaggccaagtttctcagcgatgaagacaaagttctcgctatagagcgccttcgcaacaatcagatgggagtcatgtcacgagaatggagatacgcccacttctttgaagctctgcgggatctaaagacctggctgtgggttatcatgatcttttgcatatcagttccttctaacggcatctcaacgtttggcccgctcatcatcaaatcttttgtcacggacccctacaaaaccatcttatttaacgttcctgttgggttgtcgcacgtcttggctgtttcgttgagcgcgtatgcctcaatgaagtggaaggtcaaggggccagtcattgctcttctgtgtatccccccaattgttggattttctatcatgctgcactttccgcatgatactgatcatagagccattttgcttgccggatacttttgtctttccacatttaccggcatcagtaagttacatttccactcggttaagaggtcttcatgaactgacatgaatagcgccacttatatactcttggtccgcgcaaaatacagctggagatacgaaacggaaatgtacgtcagcaatggtattcataggatcgtccgctggcaacatcttcgggcccttgctcttcacgcctgacgaagccccggcctattcacggggcttacgggcgaacattgtatttttcgcattggtccttctactcgtcggcatcacatcgctttatctgaagcatctcaattccgaccacgccaagcgaagagtggctctaggaaagagtgcgattgttctggatatgagtctggagacggcagaagaggtagagcgcatggaggccttggagagagcaatgcgcgagggaacccagcgactctcccaagacaatggagatacccgactcggaggagacgaggagaatggtgtgcaacctgacgatgtcagaggccgaaaagcctttgccgacattactgacctcgagaacgaggactttgtttttgtgttttga

SEQ ID NO: 139 - protein, 499 aa, Trichoderma reesei QM6a
MMLIKLGRSPDEVITVSPADDARILRRIDLALLPLMLSVYFLQALDKATLSYASIFGLIDDTDLVGDEFSWLGSIVYLAQLLMQLPLAWALVKLPIGKFTSAMVFAWGITLTCMTWAHNFGQLMTARFFLGAFEACVGPAFVAITQMWWRRREQTLRIGSWYCMNGLTWVFGSLITYGLASIDSHLKPYQIIFLFFGVVTVAVSGAMFFWMPDSPTEAKFLSDEDKVLAIERLRNNQMGVMSREWRYAHFFEALRDLKTWLWVIMIFCISVPSNGISTFGPLIIKSFVTDPYKTILFNVPVGLSHVLAVSLSAYASMKWKVKGPVIALLCIPPIVGFSIMLHFPHDTDHRAILLAGYFCLSTFTGITPLIYSWSAQNTAGDTKRKCTSAMVFIGSSAGNIFGPLLFTPDEAPAYSRGLRANIVFFALVLLLVGITSLYLKHLNSDHAKRRVALGKSAIVLDMSLETAEEENGVQPDDVRGRKAFADITDLENEDFVFVF

SEQ ID NO: 140 - DNA, 1309 bp, Trichoderma reesei QM6a
  CDS (1)..(505)
  CDS (572)..(1038)
  CDS (1103)..(1306)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45162.1 (51868)
  ref <309>: DATABASE ENTRY DATE: 2006-10-18
atgtcacgccgtctcttgaaccgcggccgcgctgcggcatcatcatcatcattgacaggcacttccaccaccaccaccaccaccaccaccacagccctcccagactacgagccgctttcgttccccctgtcccacactgcccgaaaggacctgattgaactgtccaataaccgaggcactgcgccgtatgagagccaactgaaagaatcgatccgccatttgggcggcagtgtcggcgatctaaacgaacgccttcgcagaggccaggatcgactggccgcactttgtgagcgccgggaggaaaagggaacggccaagacagcggaggaggagcgcctagaaaaagagctccccgaatttgagaaggaggttgagcggctcacccgcgaatccgagcgcgctctcagaggcttgattgaccggaaagccgaactggaggacgaggccgccgttttgcaggacatcagcactactgctgcaacaagcacaataggtctggcgagaggtgcagccgcatcccaaggcagaaggagaccagccaatgttgttggcggcgatgatgaggacgaaggagaccaaaagaacaacatcgaagaagaagaagaagaacaggccgtagccagcgtcatcgacaccttccgtgagctccgcgcaaagaagagggctgagtacaacggcctgagcgctcacgaacgatacgccctcaacaatgactatgtgggattcaagaagctgtggcacgaagccgcagccggggaagacgggcctccgctacccgacgcctcaagatggttttcgtcgaatggtgaaccagacatgacagtccctagtcgggacgggcaaaacggttcccttgacgacgacgacgacgtggctgtctcgcgcgaaaacctcagcatcaactgtccgctgactctgctgcccatgaaggagccgtacaggagtcgcaagtgtccgcatgcttttgaaaaggctgccattctggactacctgccgctcagaggagagcgccagtgtcctcagactggctgttcacaggtgagaaagcttgttttatcctgcccccttgacgctgacttgggtgctaacatggaggacctagacattttctcgtgcccgcttcgagcatgacttttacttggacgaggctatgaaacggaggatccagcgctggcagcaggcagaagaacagaaccagcgcgacatggatgacgaggacgatgaggacgaagcaaacgaatctcttttgctcgaaagagaacaccggacaaggggaagcggcagaggagtcaagaaggaggagagatga

SEQ ID NO: 141 - protein, 392 aa, Trichoderma reesei QM6a
MSRRLLNRGRAAASSSSLTGTSTTTTTTTTTALPDYEPLSFPLSHTARKDLIELSNNRGTAPYESQLKESIRHLGGSVGDLNERLRRGQDRLAALCERREEKGTAKTAEEERLEKELPEFEKEVERLTRESERALRGLIDRKAELEDEAAVLQDISTTAATSTIGLARGDQKNNIEEEEEEQAVASVIDTFRELRAKKRAEYNGLSAHERYALNNDYVGFKKLWHEAAAGEDGPPLPDASRWFSSNGEPDMTVPSRDGQNGSLDDDDDVAVSRENLSINCPLTLLPMKEPYRSRKCPHAFEKAAILDYLPLRGERQCPQTGCSQTFSRARFEHDFYLDEAMKRRIQRWQQAEEQNQRDMDDEDDEDEANESLLLEREHRTRGSGRGVKKEER

SEQ ID NO: 142 - DNA, 1511 bp, Trichoderma reesei QM6a
  CDS (1)..(636)
  CDS (699)..(1177)
  CDS (1246)..(1367)
  CDS (1465)..(1508)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45176.1 (111374)
  ref <309>: DATABASE ENTRY DATE: 2006-10-18
atgctaacaactcgcaaagtcccccaacggcaccagcagcttgcttgccaccttcgaattgatgaagcaacaagctccccttctatggggctgaaacgcacgaataaatgggaggccaagatgttgcagacacaaacacctgacatgctgccggatattggcggtggcgtgcacggagtcatctctcgcctcgctgttgagatcggatcccatcatctatctccatggacgcctcacccatggttcttatcagttccccagcttgcgcttccgtcagatgtttactccaaattactgctaccgctccaggccataacagtggctttcagggctctttctgagcgtgattcgaagttgagagcagaagcgtatcaatactactcccgaggcttggagcgtcaccgggctcagcttcaccagttcgccataacgcagaggcgccagcttcttgcttccattcttaacgacctccttatgtcaatggcgcttctggagtttgagatgatggctcctcttgctatcgattcctggttcccacacgcttatggagcgttgagccttttggaacatgttacgcccgcgggctgccaggagtcgcctttcttcgaaatcttctggcagttgcgcttcttcatggtgagtcctgtgtagtttgctgaagacccggatggcagtatataagctcacgatcttgacagtcctacgtgacactgtctacccgcaaaatgacgttccttgggtcgcgatcctggagggagataccctttcaacgccgcggcaaaaccgaatttgactgtgtcattgacggtctactcctccatgatgaccaacataaaacagaagatttgtcggacactgggcctatcagaaggcaaacactcgatgagagttcacgccaaggacaagagggatacaagtccccccgtcagaaccaactcgccgatcagacgcgcatgattcgactgctcaggagcgtgggagagctcgcatcggcttgcactgtcgatgatgatcctaaaagacaggaaagtctatcaatggccatcctttcagagtccaaacaattgatggaccaaccgttcctgccgttcaacgttgggctgcaagtgacggccgtagcaaatctggtgtctcgatatgcgttgaatcctgtgcagcaacaagaggcagcaacgctgtatgccaactggcgcggccgttttgcattgacatgttgatcaacggcagaggcagttcatttgacaggtctctacaggtgatacttgcttcgaagccactgctaaggatcaagatgaaagtcttcggcatcaagatacctaggtactttccgctttgtaaagaacagcttaagaaggcacgagcttcaagtgagtggctgcctcgcgggagttgcacgtggcctcaatcgtttcctgaaccctgaataatcctactgactttcgactgactaaccacgttacctagtacagctcaacatcaaatcgagtctgctcaagggcagctatccatga

SEQ ID NO: 143 - protein, 427 aa, Trichoderma reesei QM6a
MLTTRKVPQRHQQLACHLRIDEATSSPSMGLKRTNKWEAKMLQTQTPDMLPDIGGGVHGVISRLAVEIGSHHLSPWTPHPWFLSVPQLALPSDVYSKLLLPLQAITVAFRALSERDSKLRAEAYQYYSRGLERHRAQLHQFAITQRRQLLASILNDLLMSMALLEFEMMAPLAIDSWFPHAYGALSLLEHVTPAGCQESPFFEIFWQLRFFMSYVTLSTRKMTFLGSRSWREIPFQRRGKTEFDCVIDGLLLHDDQHKTEDLSDTGPIRRQTLDESSRQGQEGYKSPRQNQLADQTRMIRLLRSVGELASACTVDDDPKRQESLSMAILSESKQLMDQPFLPFNVGLQVTAVANLVSRYALNPVQQQEAATLSLQVILASKPLLRIKMKVFGIKIPRYFPLCKEQLKKARASIQLNIKSSLLKGSYP

SEQ ID NO: 144 - DNA, 50574 bp, Trichoderma reesei QM6a
  CDS (1)..(56)
  CDS (257)..(312)
  CDS (404)..(438)
  CDS (661)..(1145)
  CDS (1211)..(1475)
  CDS (1558)..(1702)
  CDS (1742)..(4623)
  CDS (4666)..(10893)
  CDS (11122)..(50571)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45233.1 (123786)
  ref <309>: DATABASE ENTRY DATE: 2006-10-18
atggctgttctacaggcgtccaaacaacaaacgccagcagctactatttgctcgtagtatgtaagatcgacggatcaatactctgtatacctatgcatccgcactgaaacatcaagtcacagccagaactacatgtggccttgagctggtggcgtcggcggctgatgatgatgtccatcctcaacgatgaggcaacgtctgccccgactctgtatatgccataccattacctttaatgatacgtagctgataatagcctggatccctggccgaagttgagagaatggtgttttgataggtgggacaatggcggtaagtcgacagggggccctccccgtgaactcgggtaaagctgcatactacacgtaagtgttgaaaactctgtgagacattgacttaacagccatgctgcaatcattggctacatattgtgccactgtgtgtaggtaatactgtcataagtattagtaggagccggagtgtgcattgccgatccttgaggagagacattctcttataacggcctgcctcccacacagctgcacggccaaggcaacttcgtcggtacatgctcaattcctgttgaaaagtttagttattttattattcggtcttgtacaaaagtactttctacaatcttttaatatgactggaatcaagtctccggctgaagagccaggagctagaggtagtaccaatggctctatcgaaagctccaagcatcaatgcggcaatactgcaaagcagattgacgtcgcgatttgcggcgttggactccgccttgctggtggtattcacagcatcgaagagttctggcaagcattggtcggtggtctggttgccgaagggtctgcgtcaaatgctcagaagagcggccaactgaacagaagcttgagcgcgtttgacgcgcggttcttcacaatggcagctgatgggcgaatcgacagtgatccgtattctcagaagctgtttgaggtcgtccacgagtgtctcgaggacgcgtgtgaggtcaactatcgcggcgaaaaggcttccgtggcttgctacgtggcgatgcctggccgaaaggacgtagaggccagggagaagggaaatgcctcgacggttgagcttgtgtccaagcagtttgaattccgcggaccgaggtgagtagtcttaaatgggctctagttgaagcaacacgcggaggctaaccatccatactcttcagcctaactattgaggatgctgaagactctgcctcgctggtgacacttgatgaagcctgcaaggctgtcagaaacggcagcgcccaagccgctctcgttgcgggcatcaacctcatcgccaccggggcgactgcggatgatctcgagggagaagcggttgttgcagtgttcatcaagccgctgagcgatgcagtccgcgatggaaatcctattcaggccgtcatccgcgctgccagttcggattcgagtgatgctgaagtcgttgaagtgagtctcctttccccatccagatggattgtaagatttgaacacggaagaagagtctgtgaaactaacagtggtcatgcagtgttccgatgtccttatcgctgggagctcctctcagcctgaccagggcgatctgaagagtgcatctggcctcgtcagtctgatcaaagccatggcctctttggagcatcaggacgtcctgtattcagccaccactctatcaaagggtaagaatttgagtcaacagtgtttttgtttgccgccagctgttgttgttgtcaacgtccagcgcttacctaagccagcagatgaaacaccaagccagaagcacctcgaccttccctctggtcgagctcaaagaatccgcatcaacttcgctggaaaatccgggcatgaatctcacttcgtcattgagccgcatcggcagcatgaatccccggcaagcaacgatgctgctgggccacagctggtgttgttctctgcaaacaacgtgacgtctctcaaccagcagatgcagcttcaccacgacttcgccagatcgaacccgcatctcgtctctgacattgcctacactcgagctattcgccgagaagctcttgatcaccgagcattttctatcattggaaacgatggcgtatgcctcagcacagcgagccccgccaaatgcccagttgctcccccgtctatcacgatggtgttcagtggtcaaggagcgcaatgggcaggcatgggaaaagagcttcttcggatcgatgcgttcagaaatgacatcaagagtatggatagcatcttgcgtcaactgaaaacgccaccctcctggacgatcgaggaggagatccagcgatcagccagcgaccctctttgtcggatcaactctgttgaaacggcttgtgtggtctcgaccgctctacaggtcgcactctttcatcagtacgagcgactcggactcaaggcggaagctgtcgttggccactccagtggtgagattgccgcagcctacgcggcaggctacctgaacctgaaggaggcaaccgtcgtggcctattactatggctatgccgctgcgatgagcgtatgcgacggggctatggcggtggccggcctcagcgctgaagagacaagagagttcctgcgggatggagccgtagtggcctgcgaaaacagcccgacgagcacgacaatctctggcgaccgcggcgtcgtggaggatatcatggcttcgatccagctgtccagaccacaagttaccacgcggaagttgcgtgtcgacacagctttccattcccaccacatggaaacagtctctgccgaatttctgcgccttctacaaagcgaaggaatcacttcgacgcagcaaacaacgcggaatgccgtcttcatgtcgagtgtcagcaacacaatcctgacctctgccaaggactttggcccccattactttgtcaataacctggtttctcccgtccgcttctcttctgcagtcatgtccattctcgacaccactcctacacatggtcttttccttgagattggacctcactccactctgtctggtccgctatcccaaatctgctctgctgccagtctgtcttgcaactacatctcatctcagtccagagagacggactgcttggcgagccttctctcggcgattggccgcctctggcagaactctgtggctttgagcctggacaccttgtttacgggacaagcactctctggcctgccccgttacccatggaactacggcgatgacaatgacagcgaccttgcggatgcgaacaagatgcacttgtctgcaaaggataggcgagcacagatcctcaagagatccgcgtcaagaacgccttgcaacctctcggccgacgagacaccagagacggacttggagctcatcttgcgggccatttgggcagatgtacttcgcaacgtcatccaaatccgcgttgaggatattggcaagcaccacaacttctttcttctcggtggcgattcccttaccacaactgagcttgcaacggctgcctatcgacatggaatccgtctgtcaccgacggatgtgacggagaatcccgagcttgtacgcatggctgctgttgcggtgatcgacgatgctgaggaaatcaacaacgctaaaccgttcagcttgatttctagcgaggatagggacgatgtcgaattgaacatccagagacaatgccgtctcgctgctgaagcactggaggatatatacccttgcaccacactgcaagagggattcatggcactgggactcaggcaacctggatcgtacattcatcgacaagtttataaagtcatgccgcatgttgaccttgatcggttcagggtctcctgggacacagtcgtcaaacactgtggcagtcttcggtcgaggattgttctggtcaactcgcaagcctggcaatttgtggttgccactgacactgcatgggatgctccagtgtacaatgtcgacgtgaacgaatatctgaaggagtctcgcagttttactatgagctacggagattgccttagtcggagtacactcttgcatcaagagaacggcgatatctactttgtctggatcgttcaccacgcggtttttgacggtctgagcatgaagattgttctcgattcccttcagaatgcctatcacagcatgcactcaattgaacccccgccgccatattcgaacttcattcggtacattggatcgctcgactctaaccgttcccgcgagtactggaggaaagaactggatggtgcacaacggtcccagttccctgttgcttctatatctccaacatctcgggatcgcgtcttcacgaagtccatgccgttccgcaactccaaagcatcgatcacaaccgctaccattatccgcgctgcctgggcacttgttcttgctcagtactgcggctctgacgatgtttgctttggtatgacgctctctggccgacaagcccccgttcccggcttgaacgagattcctggtccgatgatcgccacggtacctgtgcgcattcatgtgaagcgcgacatgctcatctctgagttcctgcagcacattcagtcgcacgcgtctcacatggttgctcacgaacagtacgggttacagaacatctccaaacttggcccgaatgcaaaggaagtgtgtgattttgccaatttattggtaattcaaccaacccagcatctctcttcagtggcctgctcttccttgaactcgatcctccagcaaggcccggtggagaagacgatttcggaggaagccatgcgcaactatttcaattatccattggttctgcaaacccgacttggaaatgatgccattgatctcgagttcacctattatgatgacatcttgaatgaggaccagctgggagcgttattccatcatttcgaacacgttatccagcagcttcttcagccagatgatatacctctgaagtctgtcacttcatccagccaatgggatttgcaacgtgtcagggaatggaacagtgaagagcctgaaattgtttcctcatgccttcacgagatcattgaacgccatgccctcaagcgaccagatgctactgccgtctgtgcatgggacatgacattgacatatgaacagctgaaccttgccgctgatagacttgctcactatctgatcagcaactctgcggctcaggtgcaactgggcgatctcgttcacgtttgctttgaaaagtcagcatggttcatgatctccatcctggcgattaacaaagctggagctgcttgggcccctctcgacccgtctcacccggtccaacgccaaaagcaaatcgtcgcgcgaactaatgcaaaacttgcgttgacttcgtccagcaatgctgctctttgctctgaactggttgagcatatcattgaggtctctgctgatcttgacgacatgctgattgcggagagacgaggtagcaagggactgcctcgagtgtccccgagcgctgccgcttatgtgctttttacctctggaagcactgggacccccaaaggctttgtcatgcagcatcaggctgtttgcacgagccaaacgtccgctgtcagaaggctaggcatgacgtcggatatcagaatgcttcaatttgcatcatacgtctttgacatgtcaattggcgagattgtcggtccatgggttgccggagctaccatatgtgtgccgtctgaagaggttcgaatgaatgggctcgttgagtacatacgcgacatgaagatcaactgggtttaccttactccttcattctcccgcacgcttaacccggacaccctccctggtctcgatctgatgctgcttgcaggcgaggctgtaggacgtgatgtgctagagacatggtttggcaaggtccgtcttgttaatggatggggaccagccgagacgtgcgtgttcagtacactgcacgaatggacatcgcttgacgaatcctctttgaccatcggcagacctgtgggtggcttctgttggcttgtcgaccccgaaaacccacacgttctagcacctattggaaccgtgggtgaagttgtcatccaggggccaacgttgctcaaagaatatctggcggatcctgaaaagactgaagcggcgacggtcaggtcactgccggactgggcgccctaccgtaatctagcggattggaatcgattctacaagtctggcgatttgtgtaaatacaatccggatggaactctcgtctttgtcacacgaaaagacacccaaatcaagatccgaggtcttcgagtcgagttgggagaggtagagcaccagatcaaggcatcccttgaaggagtctgccaggttggggtggacatggtcaccaccgatggtggttcaagcttgattgccttcttttgcttcagcaatgaaacaagaatggtgacgacagttaacgccgcggccgatgaaggcgccgcaatgttcctccctgtcaccagccagttgaagagccagatcgtcagcatgattggtcacctatccgtgaatcttccaagatacatgataccgtcattcttcgtgccatgcaaatacatgccatcgattacgtcgaccaagctggacaggcgtacgttgaagaaccagatcgaattgctgggtcccgacggcctgtccacctactcgcttgttgatactgtcaagaacccaccagaaacggcaatggagagcaagttgcaagcgctttgggcgaaacggctgaaaatgccactggaagccattggaagagacgatagcttcttgcagattggcggtgattcaattgctgtgatccattttgtggccgatgcccgccaggctgggatatctctctctgtccaggatgtcttcgacgatccacgactgtggcgagtggctgccatcgcaacttctgccgacggagactcccattcggctccaattgtagcgccatttggccttcttgagcccggccagatcgactcagtgatgcaagatgaactgcttaagctgtgcggcttgcccagttgggatgcagtcgacgatgcgttcccttgtactaaactacaggaaggactgatggcgctgaccacgaaacaaccgggagcatacgtttcgaagatggtgtttaaggttccgaggcatgtcgacatcggtcacttcaaggcgtcttgggagcgaacagttgccgtttgcagcaatttgcgcaccaggatcgtccagctcagcagcctggactctatccaggtcatcgtcaaagaacctgcgcaatgggaagtcacagacaatcaaggcatagacgtctttttgagacaagcgaatagtatccgcatgtcctacggatcacggctcgcccgctttgcactcgtccatggtgacaatagcgattgctatttcgttgcaatcatgcaccatttaatctttgatgggtggactctggctctcatggtccaggcgttgcacgcgatctacagagacagtgaagtgccgagactggccccctactcggcgttcgtgcggtacacgctgcaactcgactttgagacttcgaagacgtactggaaggcacaaatggatggagcgagacgtgctgtgtttcctttaccaagagacgatatagcagttgccaaaagcaagagaaacgttcaaatctcagcgaaagaggttaagataccacagacgacaaacgggactattacgagagcgacctatctacgagctgcgtgggctatgctccttgcaagatactgcagcacagatgacatttgctttggtgcctccgtttctggtcgcaacgctcctcttgtcggtgtggagagcgttcttggcctggttgtttcgacgctcccagtccgagttcggctgaaccccgatcagtcactgtccgactttcttcgtgatgttcagaagcaatcgaatgatatggtggcacatgagcaattcgggctacagaacatagccagaattggctctgatgcaaaggacgcatgcaattttaccagtctcatggttgttcagccaaaggacctgacaaccggttccaacggaaacgaagcgatccttatctccaccagggaggaacagcgtttggcatggcagtcgatggaagactactacaattatcctcttatcctccaatgccacctgggggatgacagcgtcgagcttgagtttgtatatgatgcagacgttatttccgagttccaagtgcttgcgttatccaaccagctcgaccatatcattcaacaacttgcatctctggacaagagaacgcttcttcgagatgtatccagagcaagcccgtgggatcttcagcagagcttggactggaactctcacgagattgtggtccaaaaacactgtatgcatgacctaatctctcagcgggctaaattatgccccgatgatgaggccttgttctctaccgaaggatcgctcacgtacgctgccttggatcgcctgtctgatcatgttgcaagtcagcttttgcaatacaacgtccagcctgagacaattgtgcccatctgcatgcaaaagtccatctgggctgtggttggaatgattggtatcttgaaggcgggtggtgcatacatgcctcttgatcctacacatccagaatcacgaaggcaagccttggttcaggaggtgaatgctaaagtgatagtctcctcgccatcgatggcggcatcttgtgaaagcatggcgccgcacaccatccaggtgtcttcctcattgttagcacttgctcccgagacgcctgtggactatcattcgctgagtaactacaagaaaccggagcctcataacgctgcgtatgttctgtacacttctggctctacgggaaagccaaaaggcttgctcgtcacgcactcggcggcttgcacttcgctgttgaagcattctgatatgttcaatttcaagaagtcttcacgagtcttccaattcgcgagctacgtctttgacgttagcgtgttggatatcttcctgactctcatccttggagctacgctctgtattcctacagaaaccgagaggatggacagagcatggcgctttatgactaaagcacgagtcaccttggcgtgcttgacgccatcattcatcagaactctcgatcccgatactctccccactctacagacagtcgctatcggcggagaggctaccacgaaggatatcctcaaaacatggcacgggagagttgagctgataaatgcctatggacctgcggaagcttgtgtcaattgtgctggccaccccttcaagtctcaggacgactcacccatgactattggacgtccatttactcaccggctgttcatcgtggagccggacaaccatgatcgccttacgccagtgggatgtgttggtgaactacttgttgagggccatgcaattgcgcgtggctatatcaacaacgaggagaagaccaaagcctcctttgtcgattcccttgactggctgcctactcaaacagagagtgatagaccaatagcctacaagactggtgatctcgcgagattcaaccccgacggaacggtggagttcttcggacgacaagacacgcaagtcaagttacgtggtcagcgactggagctcggtgagattgaataccacatcaaagcaaaccttgcagatgtacagcatgttgtggtggatctcattgagcgtgaagcaggcaagatgatcattgcctttgtcacattccacaactacttgtgcgataataccccgacggatgctgaggatccttatgccgaatttatcagcaatgagatatacgtctcttccttccaggccctcatccaggagcttcgacgtgtcctaccaggctacatgattcccagcatcatcttcccaatgagagatgtgcctcatacatcgtcaaacaagatcgacagaagaactctgcgtgaactcgcaaccagcatgcctcgcgaaagaatatctagcttttccattgcacgccaagacaaagtcccacccacgacggaaatggagctcaagattcagagtctctgggctcaagtgctcaagatcgatacagaagatatctccaaattcgacaactttttcgaggttgggggtgattccatctccgcaatccatctttcgaaccttgctgcacgagaggacatcctgcttcccattgcaaacatcttcaaagagcctcaactggcttcaatggctgcctgcatgaccatcaggcagtcacagcatactgacgctcaaccgttcagcatgattgaagcgacagaggtggagtctttacacgcctcgattcggcggcagtgtggacttgcgaacgaacaagaacttgaagacataatcccttgtacgccgctgcaagagggtctcatggctttgactgcgacgcgtccaggctcctacattgccagacgggcatataaactggcggacggcgttgatcttgatcgtttcaaggactcctgggaacgtaccatcaaggcctgtagtagtttgaggacgaggatcgttcagcacggagatgtatcactacaggctgtggtctcgcatgatggcttatgggaagagactgatggtcaaaccctccagtcctacatgaaggggttgaccagcctcaatatgggctatggctcgcgactttcgcggcatgcaatcctgagttgttcaaacgggtcgacgtactttatttgggttgcccatcatgctatcttcgatggctggacaatgcagatcaaacttgacgttctccaacggctgtatgcacaggagcctcttccgcccattcgcccattcgccaattttgtgcaatacctgtcacagcttgatccaaaggcggctaaggactactggcttatggagctagaaggtgctcagagggcttcattcccacccgccaaagtcacaactggcaacaagacgtcaacggctcagaagactcagatcatgaagagaaagctagcggtaccaactcaacccaactcctctgtcacaaaagcctctgtacttcgaggcgcttgggcgcttgtcctcagcatgtactgtgaaggcgaagatatttgcttcggcgcaactacgtcaggtcgacaggcgcctgttcaggacctcgtcaacatcgctggcccaacgattgcaacagtccctgtgagagttcgtctagatcgttcacaacatgtttccgaatatctgcagaatatccagacgcaggcctccgagatggtggcttatgaacagtttggccttcagaacatatcgaagctcagtgatagtgccaaacacgcaaccgacttcaccagcttgtttgttgtccagtcgagacaacatgagatcggaaagtcccagggagagctcttcaccactgattccaatgatgaaacaagcattgagaattggatagaggacttcttcaactatcctttgacggtagaatgtgatttgatgcaggaccaggctgtcatgacgctgtactacgatgctgatgtactctccgatcttcagcttcagggtctatgcaaccagttcgagcatgtcttgcaggagctgaaccttcggtataaggagccgctcggaaatttgtcaatgactagtcaatggggtattgactttgctcacgcctccaaccccgacaaacctctcgttgttgagtcatgcattcacacgctgattgaacagcgaacaaaactgaaccctgagtctcctgcggtctcttcttgggacgctgatttcacttattccgaacttgatgaaaatgccgacaagctggcgacgtatctcctgagcacgctcaaagtgaaggctggtgacctagtcatagtctgcttcgacaaatccgcctggtttattgtggcgatcctagcaatcaacaagattggtgccgcttgggtgcctcttgatccagcacatccaacggatcgtcatcagaatatcgttggtcagaccaaggcaactttggctctttgttcccttgcaaacgtgcccaagctcatgggcgtgaccaccagtgtcctcgaggtcaacggagagttcatgtccaggctaccactcaatgatgcggttaagcccagtgtgaaggtcagccccgatgatgtcgcatacatcatcttcacctctggatccacaggggttcccaaaggtgtcgtgattcagcaccgcgctatctgcagcagccaagtcgctttgagtcagagactcgagatgcatgacggtgtcaggatgcttcaattctcctctttcgtgttcgatgcctcactttttgagatctacagtccccttatttcaggcgcctgtgtttgcatcccttcatgggatacacagatgaattcattgccagctttcatacgcgaaaggaacgttacctgggcattcctgacaccgtcagtggccagcattatcagaccggaagacgtgccttgcttagagcttgtgactcttggtggtgaggctccaagcaaagaagtcgtcaacagttggctcggtaaggtgcggctgttcaacgtctggggcccaacggaaacaacggtcatcgccatggtacatgaatacacagctactgaactctctcatctgaccattggacgcccaatttgtggaaactgctggatcgtcaaccctaatgaccctcatcagctaagcccagtaggcaccgttggtgaaatcgtggtccaagggcccaacctgcttctcgaatatttggagaacccggagaaaacggctgccgccactgttacctcgcttcctcactgggttcccaaccgcgaggtgtttggtcgattctacaagtctggagatctggctacctataacgcagacggcaccattagatacaatagtcgcaaagatggtcagatcaagatccgcggtctccgtgtcgaattgggtgagatcgaacaccacattcggaacaacttggaaggtccatgccaagtcgctgttgaagcgctcaagttcgaagctggtactcatctagttgcctttatctgtcagaatacggataccattccggctagcatgactggtgatgtggcaacggaagatatcttccttccgtcgacggcagatctgaggagcgatttagaggcgatgcacggtttcttggcttctgctcttccaagctacatggtacctaccttcttcattccttgcaagaagatgccactcgtgacatcctccaagatggacaggaaactcttgcgtcgtcttgctgcggcattggataggcaggcctttgagcaatactccctgtatgcggtgaccgaggccaagtccagtccagagaccccaatggagcacagtttgcagcagctttgggccgatgttctcaaagtccctgctgaatcgattggaaggcatgacagtttcttggcaatcggtggcgattccatagccattattcgcctcattgccctggcccgcgagcatggtatcgagcttcgagcgaacgatatcttcaaggattctcgactttcctctgtcgctttgaacgcagcgcctatcgaagttgactctagctccgccaattccgccatttctgcaaagccgtttgcgttattggagccgcacattcgagacgccctcttggcgccgcgattgagaaaggagctgaaattgactcgctcgatgaagattgaggacggctatccgtgcacaaacctgcaagaaggtcttatggtcctggcagtgaaacagcctggatcgtatatcacgagctttcactaccgcttagcagagaacgtggatccctccgccttcaaagccgcctgggacaagactgtacggctatgcggcatcctgcgaacaagagttgttcacctcaagggctcgtcggttcaggtagtcataagcgactacacttgggacgatacgaagggtatgactttgaagtcttaccttcagtcaattgagcatctggaagttgagtatggatctcgcctttgccgatatgcgttgattaaggacgagaacaaccagacgcacttcatctggaccatgcaccacgctatcttcgatggctggtctatacgagttgtcctcgccacgctcgataacgtgtataagggaatgaagaccacagctttgacgccctattctcgtttcattgaatacaccttggctatcaacccccaatctgctgctgactactgggtggaacagctttgggatgccaagaaggcctcgttcccccccaatacgagcgggaagcttcctgagtattcaaacggctatcggtcaatggtgacgaatatcaaacttccagatctgagcgcaactggcttcacaagggctacaattcttcgtgctacatgggccttacttcttacccgttattgcgagacagacgatatctgctttggaacaacaatttccggtcgacaagccccggtgagtggcataatagacatgccaggcccagccattgcgacagttccattacgaatccgagtgcctcaacagaaatcggtcgccgccttcctgcaggaggtccaagaacaagccctggcgatggtcgaatttgaacagtttggtctgcagaacatcagcaaactgcatgcttgtgctaaggaggcctgcgacttctctagcttgctagttgttcagccgaaggaagccttggaccctgctggtgaccaagacgctatcctcattgcagctgatgggaaggttgagacaggagagtatgctcttcaaaactacttcagttatcccctcgttgttcaggggcatctgtacgatgaatcgacggaactcgttctcatctacaactctgccatcctgcccgaagagcaaattgtcgcgttatcgcaccaattccaccatgttgcaagggagcttgtcctcaagttgcagtcaaatgttggctccatcgcaacgacatcctcatgggaccttcaacaggcgatgaagttcaattccgaggtgccagaagccgtcgatggctgctttcatcagctctttgagcgtcaagcccgtcagacacctgacgccatggcgatctgcgcatgggacggtagcttcacatacgccgagctggacactgcagcgaatcgcttagcatatcatcttatatctcagcacgcgattaagccggacgaactcatccatgtgtgtttcgagaagtcggcttggtatttcgtgtccattttggctatcaacaaggccggcgccgcatgggttcctcttgacccctctcatccactggaacggctcggtcagattgtcaagcaaacgaaggctcagatggtgttgatatctgaatctcacgcctctctttgcaaggatctgataccaattgtcattgaggtttctgcttctctagatcaacaactatcacgcaatggtgctgctttcagtcagaacccgccgaccaccaaggtttcgcctgctaacgcagcttatgtcctgtttacatcgggtagcaccggcgtcccgaaaggtctcgttatggaacatcgatccgtctgcagcagtcagagagccattgttcgcaggctgggcctccattccaaggtccggatgcttcaatttgcggcgttcgtgttcgatctctctatcggagaaatagttgcaccacttatctctggtgcctgtgtttgtgttccttcagagcaggcccgcatgaacgacgttgctggcttcatcagggatgctagtgtcaactgggcatacctaacgccttcatttgttcgcgttctcaagccggaagatgtcccaggactggagctactgctgctgtgtggagaggtcactcctcgagatgtctttgacgtttgggttggcaagttgcgattcatcagcggctggggtccagctgaaacatgcgtgttcagtacgctgcatgaatggcagcctcaggattctccattgacggtgggtaggccagttggggctttctgctggatcgtggaccctgagcgttctgaccagctggccccgattggaaccgtgggtgaaatcatgctgcaaggcccaacgctccttcgcgaatacctggatgacgctgaacgaacagcatcctcaacggtaacgtgtttgcccgattgggcgctgcaaaaggcatcgcagtggacacgcttctataaatcaggagatttggccatgtacaatccggacgggacaatcgagttttgtagtcgcagagatactcaagtcaagatccgcggcttacgtgtcgaacttagcgaagttgaataccggattcgcgagagcctggaaggcatttgccaggtagccgttgacatctcgacatccgatggtggctcccgcttggtctcgtacctttgcttcactgaagagactcgctcctcgacgagctcagagaatagcatggacgacattctcatgcctataacagtcgaagttcgacccttactagctgctatggtcggcaaattgagggtgtccattccaaactacatgattccgacccttttcatcgtttgcaggtatatgccttccatcacatcgacaaaactcgacaggacggcgcttcgtcaagttgcctctctcctgacccaggatcaaatctctatgtattcgctttctgatgataacaagagaccccctgagacggacatggagcgaaagttccaatcactctgggcatctattctgagcataccggctgattcaatcggtcgcgatgacagcttcttgcagattggcggagattcgatctctgctatacacctggtgtctacagcgcgggctgagggcctggtcatcagtgtgaaagacgtctttgacgattccaggttactcgcaatagctgcgaaggcggtcttcagtggtaaagctgaggggagggacaaccaaattgcgccattcagtcttctgccgccgccgactcgagacgcaatcgtcatgcaagcagctgagcaatgtggcattgcacagagtgccattgatgacgcctatcctgctacttcaatccaagagggtctcatggcactctctgtgaagcagcgggggtcatatgttgctaaatatgtatacaggctggccagccaagtcgatataggtcgcttcaaagccgcgtggatgaagactgtcgagctttgcggcgctttacgcacaagaatcattctctttgatgattcatcgatccaggtccttctaaaggacccagcctcctgggaggcaaccgacaaggagacactctcttcccttgtccgctcggaccgaggccttcaaatgagctatggtacgcctctctgttggtacgcaacagtgcaggaagcagacaccagctactttgtctggtcagctcatcatgccatttacgatggttggaccattcgtctcattctgagtaccctggagagcatctacagaaacgtagagccatcaccgctgcaggcatacaacgccttcgtcaaatacacattgtctctcgatcatgatgctgccacgaacttctgggctaacgaacttcagggctcaaagcgggcctcattccctcctctcaacggtaccaacatgggaactgatggccagcctacccaggtacaccggagaaccattgctctccctgtaagggaaaggtcatccatcactaaagcatctatcttgcgtgcggcctgggcgattgttcttgcacgttactgcgacagtgatgatctcacctttggcacgaccgtgtctggtcgccaagcgccagttccgggcttagaagcaatgcctggactagcaattgccactatcccggtccgtgttcatcttgatagccagatgaaaacttccgaattccttcttggcgttcagaatcagacgacagacgtgattccctatgaacaatatggaatacagaatatcgccaatgtcagctctgatgcaagggaagcatgcagtttttctagcttgctcgttatccagcctcccgcttcatctcaagcggactccgaggaggccatacttcttgctggggaagctgaaagtgccctgaccgaagacacgatggactcatactttaactatcctcttgttctcatctacgggatagccggcgacaacgttgagcagcgcttgttcttcaatccaggagtgctggccgaaaagcaagttgaagccctctcttaccagatcgagcatgttgttcagcagcttgccaacgatgtttgtctcggagatatctctctagtgagcgactgggacgtgaagcatgctagggattgccagacactgaagcttcccgtccagtcttgcactcactggcttattcaagatgcgatccgcacctatcccacctctccagctgtagtctcatgggacggcgagcttacctatagtgagcttggaagcttggtcacccgcctggcagctaagctacgacagcttggcatagggcgcgagacctttgtgcctatatgtttccccaagtccgtctgggccgtcgtgacgatggtcgctgtggaactggcgggtggtgctttcgttccgcttgacccgaaggcaccacggacacgaatcagcagtgtgctcgacgacattaaggcgacaattgctctgacaagcccgtgctgcgcatcggttatgtcaggccttgacattcctgttgtcgttatcgatgattcttttgttgccaccttgcctgaggctgctactccagtacagcaaactgactgcccgtctgatgcagccgttgttcttttcacatctggcagtacaggtcgaccgaagggcatggtcattcagcatgataccctctgctcttcggcaaatgcatatggttctgacctgctgattggacctggtagccgcgtttttcagttttcagcctacacgttcgacgtcggtattctagatactctcgttacactcatgcgtggcggttgcctctgtatcccttcagaagaggatcgactcaacgacctatctggtgccatcaacaagactcaagcaaattgggtattcctgacgcctacggttgctgacctcctcaatcctgccgacgtaccgacacttcgtgtagtgtgtctgggcggagaggcgatcaaccagaagactgctgccagatggaaagaccacgttgagctacacggcctctacggccctgctgaggcctctatatgtgcctggaaccctaccgtgggccggtccggcaagtcaactaatctagggaagccgcttgcaagtgctttctgggttgttgagcctaccgatattcacaggctcgcccctgttggatgcatcggagagttgctaatccagggttcattgcttgcccggggctacctcaatgtcgatgaaaagcaagctgccaattggatcgaatacttcacagcaggctggctgcctcatgactttccgaacagagcctatcgaactggcgacttggtgcgccgaaacgctgatgggactttcgactatatcggtcgtaaagatacgcaggtcaagctccatggccagcgcgtggaactcggcgagatcgaacaccagcttcatcaagttcttccagctgggatgtctgccattattgatgttgtcaaatctgtcgatgagcaacggcaagacagcctcatggctttcttatggtacaccgacagcgcgacatccaacagcccctcgcccttggaactcatcggtagcctatccgacgagcagcgtatcttgatttccgatgtagacatgtctttgtccactactctgccatcacatatgattccctcatgctatctcattttccacggcaaaccgaatcaaaccacatctggaaaagtcgacagacgttctctccttgagctggctcagaatatctcctacgatgatcggtcacgttttggtcctggtaatgaagagaaggaaacgccgacagagcccatggagttcaaactccgcgatctctgggcagaggttctccacgtgaacgctgaagatatcagcaaacgggacagtttcatgcgcattggtggcgattccatcagtgcaatccggcttgtcacgctcgctcagaagcatggtcttgctctgagtgtggctaccatcttccacaaaccacagctggaacaaatggcccacgctgtctctgtgaccgccaactctctcgtcgatgacatacagccattcaagttggtctctagtattcctaaagaggcgatcatccaggctgtgcgtgaccaaggctcattgtcgcacgctgtcgatgcctatccatgtacgagcctacaggaaggcctcatggccctggccgtcaagcagcctcgctcatacattgcgaagtttgtctatcgccttcccgatcatgtcaacgtcgattccttcaaaacagcgtgggcgaaaactgttgaaatctgcaccagcctgcgcacacggattgtttacgtcaatgagacgcccatccaagtggttcttaacgacgaacccgctgttgatggacgagatgtcgaagaagctattcagttgcaccgctctgttgagatgggctacgcattgaggctctcacttggtaccattgttaaacaaaatgatgggcgatgcttcttcttttggtcggttcatcacgctgtatttgatggcttgtccaaccgaaacattttcaccgtgctgcagaaggtttactctggccttgaagtgtcgcctcttccctcgtatgctcgctttatccaatatgtcaaatctctggatgttgacaatgctggacggtattggaacgcgcagctcgagaactgcgagcactccaacttcccagccacgaatggtatcccgaactctgagactaccacaagcattctcgagaaagttgttgacctacccaagatgcccaagtcaaacataacgactgcaacattgatccgagctgcttgggctctggtactatctcgatattgcagtactgacgatgtctgctttggaatgtctctatcgggtcgccaagcgccggtccccgacgttatcgacatggttgggcctacccttgccactgttccagttcgagttcgcttggactttgatcaatctgtgtcttgcttccttgaggctgtacaagatcaggcactggaaatgatctcatttgagcaatacggcttgcagaatattgcgaagcttggtcctgatgccaaacaagcttgccagttctcgagtctcctgcttatccagccaacggagacagagaacgaggagggtgacaacgtccttgtgaccgcagacgtcgaagttgaaagtccagccgacatggttcacaagttctacagctttccactcgttgttcaagcacatcttggcgatgactccgtcagactatccatcatctacaagtctaacgcgcttgttgaggctcaggctgaagcacttgctcaccaattgagccatgttgtctgtcagcttacgtcgctgcgcttcgcacccctaagagcggtaacacttgcctcctcctgggacctggaaaaggccatcagcttcaaccaagagatacctgacttcatcgactcatgcatccacacacttatcgaggctcaagctgaacaacgtcctgacgcaattgctgtttctgcttgggatggagagcttacctacagccaactcaacagtgccgccaaccgcttatcccatcatctgatagacaggtactctctccaaatagaggatctcgtccacgtgtgctttgagaagtccatctggcatgtgatatcggtcttagccatcaacaaagctggtgcagcttgggttcccttcgatccctcacatcccgaacagcggcttcgacaaattgtcagccagacaggtgcgaagcttgcgttggcctcgtcaggcaatgcggctttatgtggaaaggtcgtcgagcgtgtgctcgaagtgaacagcgcgagtgatgatcagctggttagcaagggtatcagttcagataacccgagtattccggtaactcctcgcaacgccgcatatgtcctgttcacgtctggttcgacaggtactccaaagggcatcgtcctagagcatgccgctgtgtgcaccagtcagaccgcgttgtcaaagagattcggcctgaaaagcaatgaccgaatgctccaattcacagcgtttacctttgacccctcagtcacagagatctttgcgacgctgatgttaggcgcctgtgtctgtattccgtcggactggacaaggatgaacgacctcgctaccttcattaaccagaactccgtcaattggactttgcttacaccttctttcctacggacactaagtcctgaggatgcacagagcttagaagcactcgtcgttaccggagaagctcccactctggacatcttcaacacgtggattggcaaggtgcgccttatcaacggctggggaccgacagaaacctgcgtgatcagcagtacacatgagtggcagtctgcagaagagtcgtatctcaaaattggtaagccggtgggcagctgctgttggattgttgattcgaagcataccagccagctagccgccatcggtgttgtgggggaacttgttgtccagggtccaacgctcctccgtgagtaccttgcagctcccgacaaaaccaaggaggcagtcgttacagatatgccaagctgggttcctcgtcaagggcttgttggctggaaccgactgtataagacgggtgacctttgctattataacccggacggcaccatccagtactgttctcgcagggacacgcaaatcaagatccgaggtcagagaattgaggctggggagattgagcatcgcatttcacaagctttgtccatccatcaagttgcagtggaagtcgtcaacactgacaatggccatactctggtcgcgtacatctgcttcacttcggaactcagaaagatttcttccaccgcgacagctgacgaagtctttgcgccgctcacagatgacacgcaacgattgatatccgaggcagtggcacagctgaggacaagcctgccactttacatgataccgacgctgttcattacctgcaagttcatgccgtccatcacctccgtcaagctggacagaaagtcgctccgacagttcacagctatgcttgatcgagaccaacttaccggttactcgttaaccgacgctgccaaggaacccccatcaaccgagatggaattgctgcttcagtctctatgggcagaagtgctaagtattcctgccgaatccatcggtcgtcatgacaacttcttccagatcggcggtgattcagttgttgcaatccaactggtttcgatagctcgaaagattggcttccccatctctgtcacggacatctccgacgacccaaggctacatgctgttgccaccaaaatggctctggctgacggccacgtcatatcatctgatgaagttccgccattcagcttggtaccccagtctatccacaaggctatatcagggggcgatgcagaacttcaatgcaaactgacggagggccaagctattgaagatgcctacccttgcactccgctccaagagggcctcttgaatacaactttgaagcaaccaggcgcgtatatagccaggttccgctaccgccttggagagggtaccgacgtttcacgctttatcgccgcatggaaccgaaccgtggaagcgtgtgcaaacttgcgaacccgtatcatcgtcataaataacagcaccatccaagtcgttgtcagaaacggctgtcgctggaatgacgaggagaagacgatgttgccaagccatggccagcaagaccttgaagttgattatggcttgccgctgtgtgactactctctgattgagcatgatggcgccaattacttctgcctccggctacaccattcaatttacgatggctggtcagttccgctgatgctcagcactttgcagagctattacactgcattggatgtctctccgctttacccgtactctcgattcgtcaagtatatcatgggtattgattctgatatctcagccgaattttggacttctcagttggagggtgccaagcccatgagctttccaacggtgagcgagggcggcaaaatcgagtcgaaacaaacgaggcttcagtcaatcaccgtcggaatccgacaatcgtccaacagctccatcacaaaagctgcgattatacgagctgcttgggctattgtgctggccagatatagcggtgtcaatgatgtgtgctttggctcaagtgtttctggccgtcaagctgcagtccctggcctggagtccatccctggcctcgttgtcgctactgtgccgattcgtgtccagatagacgaccagcagtctgtatcgacattcttacgaagtgtccagaaccaagcctttgacatgattccacatgagcaattcgggctgaagaacatctcgaacctcaacgatgcagccaaggccgcttgtgacttcaagtcattggtcgttgtgcagccggtgcaaaaactgactcacgagagcaacctgctcagcttcgcaacagaccttgagggaagcagcaaagtggaaatgctccagggttatctgagctatcccctggttgctcaatgcatgctggctgacgatagcgtcgacctcgatctgtattacgatccatcagtcgtgcctgaacatcaggtgcaaggtctctctcacgccttcaagcatgtgtttgaacagcttcttgtttctcccaatcagtcactgtcgcaaatgctcgctgaggtgccttgggaagtcgactttgccgcctcagccaacggagtcccacccacgactatcgagcgatgcgtccactctctgattgaagacgagacgctcaagcatccggccacactcgccgtagatgcttgcgacgcccgtttcacgtaccaacagctggatatttgcgccaataggttatcgcatcacctgatcaacaacttccacgtcaagaagggcgatgttgtacacgtctgttttgacaagtcagcttggtatatcgtcgccatcttggccatcaacaaagctggcgcgacctggtcgccacttgatcccactcatcctgttcagcggtaccagcagatcatctcgcagactggcgcggagctgatcttggcttctccgacaaacacatcaaagtgtaccaatctgacgcctttcgttctcgaggtgtcatctaggttggaccaggccttgtctacaaaggacgtgcttaagcaccgacccaatgtcgacgtctctccatcagatgctgcctacatcatcttcacatccggaacaacaggcatgcccaagggcgtcgtcatcgaacacgggtccttgtgtacatcgcagacggccttagctctcaacgttggcctcacagatcaatccagaacgctccagtttgcttcctttgtcttcgacgcgtgcatcttcgaaattatcgcaacgctgcttgtcggtggctgcatatgtatgccatcttgggacgaacagatgaacaacctgacaggctacatggtcaaagcttctgtaaacgccgcattcgctaccccaactgttgcgcgtagcttgaagccggaagacataccttgccttcaagtacttcttgtgggaggcgaggctgccgcgtcagatattgtatcaacgtggttcggaaagctacggctatacaatgcctggggtccaacagagacatgtgtcatcgcttccctccatccatggactggtccaaacgactctcccaggaccattgggcggtctatcttgggtaattggtggatcgtagatccaaacgatcccaggaaacttgttcccaccggatgtgttggcgaaattgtctaccagggcccaactctcttcagggaatacctggctaatccagccaagaccgacgaggtcattgtgtcttctcttccgtattgggtacccaatcgtgaattgagaggctgggatcgcttctatagaactggagacctgggacattacaatccagatggtacaatcgagtttgctggtcgtaaagatacccaggtcaagatccgtggacttcgtatcgagttgcacgagattgagcaacagatcatcacgaacctttctggtgctcgccaagtcgcggtcgacgttatgaagcgggacgaagcgtctcaactagtagctttttacagcttcagcaacgagactctttcttcccatcttggaacaggccctgacggaaaggcgatattcgcacccttggataacaatgctgcgcctcaaatccatgatttgatctctcttctcaaaggtgttctaccgccttatatgattcccacaactttcatcccctgtcaacatatgccgattggaacgtcaaccaagctagaccggaagctccttgtgcagatggccacgtcgctgtctagagagcagttcgaacagtactccctcgtcggaagtactaaacgtgctctcgaaacgacaatggaggcaagattgcagcaagtctgggctgacattttgcatatcccagccgaatcgattggaagggatgataacttcctccagattggaggcgattcgatgtcagtcatcttgctcgtctctgcagctcgtgagagcggcatcagtatcagcgccagggacgtgttccaagatgctcgccttctcagtgtggccgcgaaagccgaagtcatcgctgatgatgacgatgacttcggcgacgttgaaccgtttggtatgctggaagaagctgagttggacttccttcaaacagacgaagccaaatcttgccttggcttgagccatagtatgagtatcgaagatgcattcccttgctcgaagcttcaagaaggtctaatggccctagctgtgcaaaagccgggctcttacattggcacattccactaccgcctttctaaatcggctgacattgacagcttcaaggctgcgtggcaaagaacggttgagatgtgtcccaacctgcggactcgaatcctgaatatcgacggagcctctatccaggttgtgctccagaacgatttcgagtgggagtccacgcaagagggctctttggatggcttccttgaggcttcacgcgatattaggatggaatatggttcccgactgtgtcgttatgctctgattacccaagatgggagcactcgcttcatcttgactatgcatcacgcggtctttgacggctggacaatgcgtctggtgctcgagacgctggatagcgcatatcacggcgatgcggttgccgaactcagtccatattcccggttcatccagtatactctcgattcggatcaagcatcggcaagcgagtattggcttagccaacttcgcaacgcaaagaaggcaagctatcccaaccgtctcactccaggcgagcagccagccaacgcgaacagcacgggatacctcgagtcggagatgcaaattcccaagatttccgctggtactacaaaggcaaccattttgcgcgctgcctgggcaatcgtactggctcgctactgtgatgccaacgatatttgttttggtacaacggtgtcgggccggcaagcgccagttcctggcttggccgaaatgcctggtccagtcattgcgacgattcccgttcgaatccatcttgaagatggtggcaaaccgatctccgacttcctagaggacattcagtcacaggcaatggaaatggttgcatatgagcagttcggtctgcacaacattgccaagttgagcgacgatgctaaagacgcctgtgacttttcaagcttgcttgtgattcaaccaaggcagattctgtcgcacatcaatggagctggcgatgccctccttgttgcgcggtccgatgagtcggcggacgaagcactagaaagctatttcacttaccctctcgtcatccaagctcaccttcatgatgatggggacaagcttgtcttcatctacaacaagttctctctctctgaacagcagcttattacgctctcgcatcagttccagcatgttgtttctcagctggcttcacatcccgacctattgctgaaagacctctctatcacgtctgagtgggatgttaagcagtctgttgagttcaactctgaagtgccagagataatcgactcctgcgtccacaagctcattgaagcccaggcccaccgggcgccaaacgccttggcagtgtctgcctgggacggcgacttaacctatagccaactcaacaaatctgcaaatcgactggcgcgtcatcttgtgaagaactatgacattcggcctgacgaccttgttcatgtgtgctttgaaaagtctctttggcactttgttgcaattgttgccatcaataaggcgggtgcggcgtgggttccattggatccctcgtatccagagcaaaggctacggcaagtggtcgaccagacgcgggcgacccttgtgttgtcgtcggcacgcaatgaaaagctgtgctcaacccttcttgagaacgtcgttcgacttgatgataagctcgaccagagattggccgtcacggaaaatggcgacgaaggtccagctgttgccgttacgccgaatcacgcggtgtacgtgctctttacgtctggaagcacaggcaaaccgaagggcctagtgatggaacatggtgctgtttgcacaagccagacggccatagccaagaggctcaacctgacgtctgaggtccggatgctacagtttgcggctttcgtgttcgatctctctattggtgaaatcatcgggcctctgatttccggtgcatgcatctgtgttccatcagaggacactcgaatgaacggattgaaggaatttgtcaacgacacgaaggttacctgggcgtatctaacgccggcctttgtgaggaccctggttccggaagacatgcctgctctgcagcttttgctcttagccggtgaagcagtgcctcgggacgtgctgaccacttggtttggcaaagtccgtcttgtcaatggctggggtcctgctgagacatgttgcttcagcacacttcatgaatggtcttctgtagatgaatcaccacttgtcgttggccgccccgttggagggttctgctggatcgtcaacccggaagatccccagcgtctcactccgacaggaacacttggagagattgtcatacagggtcccacgatcctacgcgagtaccttgccgatgtcgaacgcacaaaggactcaactgtatactctctgccaacatgggcgccgcggccggactccaagaattggaataagttctataagtctggtgaccttgggtactatggtcccgacggcacaattgttttcagcagtcgcaaggacacgcagatcaagatccgtggcctaagggtcgaactcggggaagttgagcattatgttcgcgagattctggacggcgtgcgacaagtcgttgtcgacgtgtaccaaaaggagggtcggtcgaatctcgtcgcttacatttgcttcagtgacgagatgaagaatccatctgcggatgaactattcactgcagatggcttatttgcagccatcacgactgaccttcgccaaaggattgccatcatgcttggcgagctccggatcgcgttgcctacttacatgattccttctctcttcatcccttgcagatttatgccttccattacgtccaccaagcttgacagaaagactctgcgccacctgatggactcgctgaatgacgagcagcggaatgcttacgctctcctcaacagccagaaacgcgagcccgaaacagagatggaaattcaacttcaagctctttgggcagatgttttgggcatccctgctgcttccattggccgagacgacagtttcttgcaggttggcggagactccatcttggccattcagttggcctctcgcgcccgagaaatgggaatttcctttcaggtgaaggatgtgtttgatgaccccagattggtggctctgtcattgaaggctacgaagacaactgaccagttggaaactcatgtcgcgccacttagcatggtaaccgacagactgagggatgcagtctttagtgatgatgttcgcaaacaatgctgcttatccgaagagcaggtgattgaagactgctacccttgtacttcactacaagagggtctgatggctctcactgctaaacagcctggatcttacgtggcgaactatgtgttccggttacctaggcatgtcgatatctcgcgatttgttgctgcctggaaccagatgtccgatatctgctccaacctccgcactcgcatcattcacttggatggggagtctgttcaaatcgtcgttcgaggtggaaaccagtggcgatctacggagaatcagactttgtcctcagttcttgattcatccgagaacttgaagatgacatatggaacggctctctcttcctgtgctatcgttcatgatggtgacagcgattatttcgtctggtcagcccatcactccatctacgatggctggacgatgcggatcctattcagcaccctgtattcagcctactatggcgattccctgtctcctgttcggccttattcctccttcatcaactactacaggaatattgacaccggaaaggccgcagaattctggaccaaggagctagctgggtcaaagcgggcagaattcccgaccagccaacgctccatctccgcggccaggacggatgtgtaccattcgaccattgtgctaccagagaccttgaatatccctgtaacaaaggccacagttgttcgggctgcttgggcagtcgtccttgcccggtattgcgataccgacgatgtcacttttggtacaaccgtctccggcagacaggcccctgtccagggtgttgaatcaatcgtcgggccgatgatcgcaactgttccagttcgtgtccgactcgataagaacggccctgtttctcagtttttgagtgatgttcaatcacaagcatcctccatgattccctatgagcagctcggattgcagaatattgccaagcttagttctgatgcgaaggaggcttgtgaattttccagtctccttgtcattcaaccaccagctcatgatcctgccggcggggatgactcaaaggcaattctctcacacagcgagacggaacaggacgagacggaaaaggctatgcaaggctatttcaactaccctctcgtcatcatcagtggcattggcgagaaggctattgagcagcggctcttttacaactccgatgtccttggcaaggaccagatagaagcgttgtctcatcacatagagcatgtcacacaccagcttctcaataacagcggcatgcagaaggatatttccctgatcggctcgtgggaactgcaaaaggccgtcgatgcgtctcgtcttcgccctgcaacggaatcatgcacacactggttgatccaagaccaagtcagattacagcctgaccagatcgctatctcctcatgggatggagacctgacctatgctcagcttggaaaacatgtcgcgcgcttagctgcaagattgcaagagcttgatgttggacctgagtcattggtccctctctgcttccacaaatcgaagtgggctgtggtcgctatggtggctgttcaaatggccggaggtgcctttattcccctcgatcctggtgcctcgccagccagattacaaggaattctccaggatacgggagctacgctggctataaccagctcagagtgtcaaggattacttcagtcacttggcatgaaagctgttacagtggacgatcaaagtatctccgagctgccagccgagttcgacctgcggtcagaggctaggcctaccaacgccagcgtcatcctctttacatctggtagcactggcaagccaaagggcatgattattgagcacagaagtatctgttcctcgagcgatgcctacggtgccgatttgaagattgaagccggcacccgggtgttccaattctccgcatacacgttcgacgttggtgtcctggattgtcttgtgacgctgatgagaggtgcctgcatctgcattccatccgatcatgaccgtctgaacaaccttgcggccgccattactgcgtctaaagccgattgggtattcctcacgccaactgttgcagacctcctcaacccggtggaagtccctactttgaagactgtctgtctgggtggcgaagccattaccaagaagtgtgctgacaggtgggttggccatgtgagcctgcatggcctctatggcccagccgaagcgtctatctgtgcatggaactcggtagtagggagatcagggcgccccacgaatctcggacaccccatatccagtgcgttttgggttgttaatgtcaatgacccgaaatcactggtgccaatcggctgtattggtgaacttcttatcgagggtccaatgcttgctcgggggtatctgaatgtgacggccgaggtcgccgccaactggcttgaaggcgttgactggcttcctggtgacaaccgacctaggagagcttatcgaaccggtgatctcgtcaggcggaatgcggatggtacgttcgactacatcggccgcaaagatacccaggttaagcttcacggtcagcgtgtcgagctgggagagattgagacccgaattcaggagttcttgccgcaaaacatggctgcgattgtggacgttgttaaagacaatgacgccccggctaccttgttggctttcatctggaactctgatggaagctctgcctcgccagcccgtctcgtggacaccgtatcggatgaagcgcgagccatggttttgcacttggatacgtctctgaacacaattttgccctcatacatgattccgtcctcttacctcctcttcagtgggaagccggagcaaaccacaacgggcaagatcaatcgccggtctttgactggccaagcccagcatatcactgctcaagagcgtctgcgctttgctcctgataccagcttccgcgtgctcccaactacacccatggaattcaagttacgcgagctatgggcacagattctccgtattgaacctgatgatatttgcaagaacgacagcttcttacgcctcggtggcgattcgatatctgctattcagctggtgtcgaaagcccaactgcaaggtctcgatctgacagtcgcgacgatttttcaatctcctcgtctcgagcaaatggccagcgccatcgtcgaggatgagttgactgtatacagtgagatccggccgttcgatatgcttccggcaggggagtccagtaccatcctggctgaagcccgagatcagtgctcgctgcctgacagtgctatcatcgaagactcttacccttgtaccaagcttcaagagggcttaatggcgttatccgtcaagcaacctggcagttacgtcgccaaatatctctaccgccttcctgaccacgtcgatgtggctcgtttcaagtcagcttggaagcagactatgcatatttgtgccagtttgcgcagcagaatcatcaacacatcggccaagtcgacattccaaatcgtactgaatcccgagtcgagttcagagccgctaccgtatcacgatctacaagctgtactacgatatgctcagacgatcaaaatgacatacggttcagcattgtgtcaatttgcgtttgttgaagacgagcagcggagtgtgttctttttctgggccatgcatcatacagttttcgacggcctgtccacacaagttatcctgggcatcttgcacaaagcgtacttcggccttgaaactcctgtcttgactccttactctcgttttatccagtatcttttgcagatagatgaggaggctgcctctgcttattggagagatgctctacatgatgccaagccagcacaattgccttcgctgcataacacccacgacaaagtagttgctacttgtgttttggaaacaccaattggctttgtcgatgccagcaaactcaatgtgacgttagcaaccgtcattcgatccgcctgggccattgtccttgcgagatattgtgacactgacgatgtatgcttcggcatcgccacctcaggccgtcaggctcccgttcctggaatcgttgacatggtagggccggtgattgcgacggttcctgtacgagtcagactggatcgtcaacagcccgtatcagatttcttacagagcgtccaacagggcgcagtaggaatgattccgtacgaacaattcggtctacagaacatcacgaaactcagcagagacgcctatgaagcgtgccagttctcaagtttgctggtcgtccagcccatacgccacattgccaacagcgaggagagcaaggaactgctttctgctgcagaggtgaccgaaggtctctctgactccctgaacaacttcttcaactatcccctgattgtacaaggccacttgtatggtgataaggtaaaaattgcagtggcatacgatcgaaatgttttgacagagcgccaggttcaagccttatccgaacagcttggccatgtcattcaccagctcgcttcgggcgctggcacttccctcgagtctatcttgatcgcttcatctcacgaccttgaattggctttagctgtcaatagcgaggtgccggagattatcagttcatgcgtgcatgagttgattgacaaacaagctcagatctccccacaagcaccagcaatcttggcatgcgatgcggaactcacgtacagcgacttggctgccgcttcggacagactagcataccatctcatccacagtcatggtgtcaagcctggtgattttgtcagtgtctgctttgggaagtctgcttggcatttcgtgtcaatattcgcgatcaacaaggctggagctgcttgggttcccttggagccatcccagcccgaagcgcgtttgcgccagattgttctccagaccaaggctcgcctggcgttggtatcacccagtaatgccgaactctgtgccaaactcgtcacagacgtggtcgaagtcacggctgagctggatcaacaactgggccgttctgtgtcagaaccattcaaaccgctcgcaatatcgcctcgcagtcctgcctacattctgtttacctctggcagtactggaacgccaaagggttttgttatagagcaccaatcactcagcaccagccaaacggctcttgctaccagactcaagatgacctcgagtgtgcgaatcatgcaatttgcttcctacgttttcgacatgtctctcggagaatctattggaccactgatctccggagcttgtgtttgcattccctcggaccgagaacgcatggagaatattgcgactttcattcgaaagcgtcaaattaattgggctttcctcacacccgtattcgcccgcacaatccagcccgcagacgtccctagtctagaactccttttactaggtggtgaagctgtcccccaggacttgtgcctcacatggtttggaaaagtgcgactgatcaacgcctggggccctgcagaggcctgtgtcatcagtgctgtgcatgagtggacgtctgctgagacttcgtcgctggttatcggccgtccggtgggcggcttctgctggattgtcgatcctgagatgcctcagtcccttgcgccattcggcacaatgggagaggtggctatccagggcccaacactactacgtgaatatctggatgagcccgaacgaacaaaggctgcccttatacccagacccagctgggcgcctcaaccagatgcccaacactggaaccgactctaccgaactggtgatctatgcttctacaactctgatggcaaccttgtcttcggtggccgcagggatacgcaagtcaagatacgcggcttccgggtcgagattggagatattgagcatcatatccgcgacaagctggatgatgtctgcgaggctgctgttgaagtcttgaagagcactactggcgcaagtctcatagcttttgtcagcttcaagtctggaatcgagcagccagacattgagagtagtggatcgagcggtgaagtgttcctacaaccgacctctcgcatgcagaaggctttcagagccttggaaggacgtctgaaggctactctacccccctatatggtcccgtcaatattcgtcccttgcaagtaccttccatccacaacctctgacaagctagatcgcaagaagctgaaggctatggcgtcttctctaagccttgaggatctatccaagtatacgctctccgacctggagaagcagggtccggagacggagatggaaaaacggatacagctcatttgggccgagctactgaacgtccctgctacatccattggtcgggatgacagcttcctgcagattggtggcgattcaatcatcgccattcacttcgtcactgctgctcagaactccaacattgggctttcggtggcggatatctttgatgaccccaggctattagccgttgccgcgaaggcgatcagcctcacgagaagcggtcaagctgcagaaatcccccaatttggcctcatcgatgaacaaacccagcaattactttctagccaagatttgcgacaaaattaccacttggctgatgatgttgtccttcgagatgcttacccttcgaccaagatgcaggaaggtcttctggctcttacagagaaacagcctggaagctatgttgcaaaattcgtctaccgcctcggtcgtactgtcgacgttttgaggttccgatctgcatttgaagatatggtaaaactctgcgacaacttgcgcacaagagttgttatggtcgggagccaaaccgtccaactcgtccttgagaatgatttcgcatgggatgaagtacaaggacaggagctgcagtcgtacatgcacgctctaggttcgtcaaacatggcttatggctcgcgattgagtcgaggtgcgattgtcatggatggggacgaggtctactttgtgtgggctttgcaccactccatctttgacggttggacaatgcgtctcatgatggacgtccttcattcaatgtatgatggccggtccccgccgtctctacaatcgtacaacaggttcgttgcatacgtcggcaacctcaatcacgaagagacaagaaactattggggggcacagcttgacggtgcaagccgggccgcgtatcctccgctctcaaagaccagctcgaactctagcaaaagcctggagcgaggtatgcagttgcccaatatgaccgacttgtcggccaccaaagctacggtcattcgggctgcatgggcaatgctcctcgcaagatactgtgagacggatgatgtctgcttcggtgctactgtctctggccgccaagcccctgttccaggattgcccgatatgcctgggcctgctgttgctaccgtgcctatccgtgtccgattagacaagcaccggagcgtttcggactatcttgacaccatacaaagccaggccctgaagatgattccctacgagcagtttggcctccaggaaatccagaaaatcagtcctagggctcaagaggtgtgcaacttctcgagcttgttggttgttcaaccgatgcagcacttgatcaatggtgagcatgcactgcttcagcccgtcgaggttgagtcacaagaggaaagctctttgcagaattacttcacgtaccctctcgtcatccaggggcacgtcatgggcgaagacatcaagttgatgttcatctatgactcgaacgtcttgccagagtctcaggttctggccatatctcatcagatggaacacatcatgaggcagctaattgccaagccgcagtcactgcttggagatctgtctctgacttgcgactgggatgtcaaattcgcagaaaaggccaacagggaagatccaccggaaatcattgactcttgcttgcacgatctcattgagtgccaggcagagatacgtccagacgctgttgccatactgggctgggataaggtgcttacctatgacgagttgaacaaagcagccaacaggctggctcatcatctagtcatggacatcggagtcaaagctcacgacctggtccaagtgtgctttaccaaatcggcctggtatgctgtagccatcttggcaatcaacaaagtcggcgccgcttgggtccctatcgatccctcacaccctctgcaacgccatcaacaggtaacagcccagacaaaggcgcgagttgcactggcgtctcaggacaatgtggaaagatgctcccaattagttacatctgttgttgtcgtctcttcttccctggattctgatctctgtaagaagggcttcagtagctctcaaggtccggacgttttagtcactccgaagcacgccgcctatgtcttgttcacttctggaagcacaggtgtacccaaaggcctaatcatggaacacggtgccctctgtacgagtcagatggctgctggcaaacgcttcgggttcacgccaagtgtcaagatcctgcaattcgctgcctatgtgtttgactattcgatcagcgagatgctcgcagccatgatgtacggtgcctgtgtgtgcattccgtccgaagaagaccgtatgaacagactgaaggagtacgttaacgacaccggcatcaattggttattccttaccccgtccttcctacagaccttgaggcctgaggatgtgccaagtgtagaattggtagcccttggtggcgaggctgtcccacgcgccctatttgaagaatggattggaaaagtgagattcttcaatgcttggggcccgtcggagacatgcgtcatgagcgcaatgcacgaatggagatcttcagaagagtcagctttgacgattggaaagccagtgggtgggttctgctggattgttgatccagaagatccatggaaacttgcgccgactggaactgttggtgagcttattgtgcagggtcccacgttgttgcgcgagtatctgggcgacgccgagaagagcaaggctgcaatcctggaaggtcgacctgactgggcaatgtatcctgatacgcagcactggactcgcttttacaagtccggggatctttgttcttacaaccctgacggcactatcaggttctactcgcgaaaggatacgcaagttaaaattcgcggccttcgtgtggagttgggtgaagttgaatatcgcatcaaggagaccttccccgaagcccatcaagtcgtggttgatgtcttcaagtctggctcagtctcaaacctggttgcttacttttgcttcggcgatgccactgtcgacgtctcgagtaattctctcgatgatatcttcatggtcttgggagaagaaacacagcagcgtctcgcaaccatggttggcgaactcaaggttctgcttccagaatacatggttcccgccctcttcattcaatgcaagcatatgccaactgccacgtctggcaagctggatcgaaagacgttgcgaggacttacatcaagccttacgaaggaccagctggccgcctattcactggtgaatagcaaaaagaccatgccgcaaacccctatggagggcaagctacaggccatctgggctgatgtcttgggtattcctatggaaacgattggtcgtgacgacagcttcctgagtattggcggtgattccattgcggctatccggctcgttgctgctgctcgtgaccaaggagtcgcgctcacagtcagtcagattttcgaagacggtcgactgttgtctattgcatcgaaagcttctttcatcagtgatggaagctctcaagcttttacccccatcgaaccatttgctcttcttgatgaaccacagcgcgatatgatcaccgaaagcgctgaagagttcggcctcgaactttctcgagacatggcggttgaagattgctatccgtgttccaagatgcaagaaggtttgatggcattggctgttaagcagcctggatcatacattgccaagtacaactatcgcatcccgtctcatgtggatgttagccttctgaaggcagcatgggaacagattgtcaatagtttccctaacctgcgtaccagaatcatccgactgggtgctatctccctccaggtcgttgtgaagggagatactgtctgggattccacagaacgaatgacccttcggagctatttgcagcagacccgaaccatggaaatgggttacggctcacggctctgccgatctgccatcttcaaggacggtgacgaagtctatttctctttcaaccttcatcacgccgtctatgatggctggacattgtctatcatcttggaggaattccaccgagcctacaagggtctcgagcctgccaccacggttccttactcacacttcatcaagtacacaatggaactcgatcacgaggccgccggcgatttctgggcaaggcagcttgagaacgctcgaaaggcgacattcccctccgttccaattacgtctacaagcaagcccgaagcttcgcgtacaatgacagcggaacttgaactttccaagagcaacaccaccatcacaacagctacaattgtgcgtgccgcttgggcactagtccttgctcgctattgcgatagcaccgacgtttgctttggcgcgacggtttcagggcgccaagcatcgctcccaggcttgacacaaatgcctgggccagtgattgcaactatacccgtccggatccatcttgaccatgatcaaccgacgacaaagttcctggaggaagtccaaacacgagcaagcgacgcgattcctttcgaacaatttggcctgcagagtattcgcaagctcaatccagacgccgacgaagcttgtgactttaccagcctattggttattcaacctctaaagatgctttcacatctggaaaacactggcgaagatgctcttctggttggtgtcgaggacacagatgacagcgcagatggaatgcagaactatttctcatatccgcttgtcctccaagcccatctgagcgacgacttcatgagaatcgtcctgatctacaaccctcactgcattgcggagcagcaaatcgtcgcattgtccgagcagctgaagcatgtgattgcccagttggctgagtcaaagcccagccagatgctacgtgatgtctctctcgtctcccagtgggatatcgaacaatcacgcaagttcaatgtggacacccccgagatcgttgattcctgtttccacacccttgttgaagatcaggctgctcaacgtcctgatgccatggccatccgctcttgggacggtgacttcagttatgcccagctgaaccaggcggctaaccgacttgcaaattacctggtacaaacacacgagatcaagacaaacgacttgatacacgtatgctttgagaagtcagtctggcattttgtatctatcctggctatcaacaaaactggcgcggcctgggttcccttggacccatcacaccccctacagcgtcttcaacaagtcgtcagtcaaacgcgggctaagtttgcactctgctcgccagacaatagcgatctttgctccaccctcgtcgagtccgcgatccagattacgcctgaattcgacaagcagcttcagaaacaggtcaacagccgacagggccctacagagagagcctcttcaggcgatattgcctacgtcctctttacctctggcagtaccggcacgccaaagggcctcgtaatgcaacatgggtccgtgtgtacaagccagaaggcgattgccaagaggctcagacttggaccggaagtgcgtatgctacagtttgcagccttcgttttcgacttgtcgattggagaaattgtggctccccttatcacaggcgcctgtctatgcattccatccgagcatgctaggatgaatgatttgtccaagtttatgcaggacatgaacgtcaactgggctttcttgacgccttcgtttgtgcggaccctaaacccggacgatgtccctgggctggaagtcctactgcttgcaggcgaggcagttcctcgcgatgtgttgacagcctggttcggaaaggttcgtcgtctcatcaacggctggggacctgctgagacttgtgtcttcagtactctacatgagtggaagtcagttgacgagtcgcctctcactgtgggacgccctgtcggcggcttttgctggattgtcgatcccgattctgggtttcttgcccctattggcacggttggggaagtcgttattcaaggcccgactctgttgcaggaatatctcgcagacccggaacgcaccaataccagcattctgcccgctgccgagtgggctccccgtccagacgaatcacactggaacagattctacaagtcaggcgatctatgtcggtataatgccgacggaacaatcgagttttcaacgcgcaaggatacgcagatcaagattcgaggattgcgtgttgaattgagtgaaatcgaatacaatatccaacaatcactgatcggtgtgcgtcaagtggctgttgacgtcgtcaggggcgacaacggctccagtcttgttgcctacatttgcttcacagacgaaacgaagacagccggcgtcaagaccgatgcttcggagactctattcttatccaccgacgagagcttacagaaccagctgattgcccttgttggggaattgggtattgcccttccccgatacatgatcccgaccttgttcatcccatgtgccttcatgccgttcattgcttcgaccaagctggatagaaagcttctgcagacgcacctctcgactctcgatagggatcagctagcgatgtattcgttgttacacagcgaaaaacggcagccagagaccgaaatggagcagcgcctgcagttgatctgggctgagatcatgaacttgccaatggagtccatcggcagagatgacaccttcttccagctgggaggcgattcgataatggctatataccttgtctcaacagcaaaggaagagggcattactctgactgtacaggatgtgtttgatgatcccagactactggctgtagccgcaaaggctgttctgagtcaagatggtatggagccagcagactctcctccagagccattcagtctgttgcctgaagcacagaagcgccttgtactcggggaggacgcccgaaaattgtgcggcctggcgaaggaccgaaccatcacggatgcgtatccatgcagttctctgcaagaaggcctcatagcccttaccgccaagcagccagggtcctatgttgctacctatgcccatcatctctccagctttgtggacatacccatgttcagggctgcgtgggactcggtggttgatatttgtgacaatcttcgaacccggattgtcgtcttggatggcgtcatgacgcagatagtccttgatcgtgacagtcaatgggtgcctgccgacaatgaaaccctcgagtcaatgactggatcgtcgcgcaatctgaagatgggttacggaactcctctctgctggtactctatcgtgtctgagaagggtgaaaactattttgtgtggtcagcccaccactccatttacgatggttggaccatgaaagtcatgttcacagcgctgttctcagcttaccagggcatgtacgcacccgaagtccgacctttctcctctttcatcaaatccgtgaaagagctcgataatgacaaggtcgcatcgtactggacacaagaactggctggtgcaaagcgcgcttcgttcccatctcgccgaactgccccaggcatcatggaaagcaagcggttcagctcaacaattccattctccagatccatgaagacttctatcacgcaagcgtcgattcttcgagccgcgtgggctattgtccttgcccgatactgcgacagtagcgaggcagtgttcggagcgacggtttcaggccgtcaagccccgattccaggagctgagatgatatctggcccaatgattgccaccgtccccatcagagcccggctagacaatcaggcgcctatatcaagatttgtccaagacattcagagcctgagcacatccatgatcccgtacgagcaatatggcttgcagaatattgccaaggtcagcgctgaagcgagggaggtttgcgatttctcgagtctcttagttgtccagccccctgcacatggagctggagacgatcatggcgagagtatcttcgttgttgacgcgtccgcaagcgatctcacgatggactccatggacggctacttcaactatcccctcgtgatcatcagcagtctctatcctgaagagttcagactgaactttttctacgattctacagtgctgtcggaagctcgggtcattgctctgtcatcgcatttgaaccacgtcattcaacaactcgtggcgaaggaagcagtgaatgcgcctctgagctcagtctcacttctcagcccctgggacctccaacaagcagtcgagtccagccgtttggagccttctagcaacacttgtacccactgggccattcaagaaaacatccagtctcgaccagatgatgttgccattgcgtcgtgggatgcagaactcacctactcccaggtaggaacatttgcttcgcgcttggcaatcgagttacaggaacgcggagttggtcctgaaaccctggttcttctgtgcttccccaagtcagcttgggccgttattgccatggtggccatcgaaatggccggcggcgcttttgtccctcttgaccctgccgctccggcagccagactgaagggcatcattgaagacacgcatgccactctcgctatgtctagcccgactagtggcaaagtgctcgagggccttggcgtcgatgtcttctttgttgatgaggagatgctttcggggctccctagcccaacgaaaccagtgatttccaatgtacgacccgataatgcgagcgtgatcctgtttacctctggctcgacaggcaaaccaaagggcatggtcatcgaacacagaaacctggtctcgtccagcgacgcatacggcaatctccttggcattggaccgggtacacgagtcttccaattttcggcctacaccttcgatgtcggcatcctcgactgtctcgtgtctttgatgcgcggagcctgtctctgcatcccatctgaccacgacaggatgaacgacctagcgggtgccatgcggtcttcaaaggccaactgggtcttcctgactcctacagttgccgacctcttatctcctactgatatccctgatatgaaagtggtgtgccttggtggtgaggccattagcaagaagtgcgcggatcgctgggtgcatcacgtcgacctacatggtctgtatggaccggcggaggcatccatctgcgcgtggaatcccaccgttggcaaattgggtcgatcgactaaccttggaaggcctatttccagtgccttctgggtcgttgaaccaggcaatcttcggcagcttgtgcctgtggggtgtgttggcgagcttcttatcgagggtcctatgcttgcccgcggctacttgaacgtaagccctgaagttgccgccagttggatggaagacgtggattggcttccaggaggaagaaagagagtgtatcgcacaggcgatttggtccgccgcaacgccgacggcacgttcgactacatgggccgcaaggatactcaagtcaagctacacggccagcgtgtcgagctcggtgagattgagtcgcgcatccatgagctactgcctgacaacatggccgtcatcgtcgacatcctcaaggcagatgatgagaatgcccacgacatccttctggcattcctgtggtataccgacgacgagatgacgtctcggtcagaggctcttcagttgatgcacacagtttcagaacaggctcaaagcgtcatctctcgtcttgatttggccttggaagaaagtttaccttcgtacatgattccttcttcatacttgatcttcgaaggcaaaccagaacagacaacctcaggcaaggtgaatcgccgctcattcgtggagcttggtcgaagtgtctctgttcaagaccgcctacgctttacaccgagcgccagtgactacgtatcgcctacaactcccatggagctagagctgcagagcctttgggcccaagttctcaaaatcagcgatgtatcagccattggcaagcacgacagcttcctccatctcggcggagattcaatcagtgccattgagctggtctccttcgcccagcgacagaacattggcctcacggtggcaatgatattcaactacccgcgtctctcggcgatggcagaggccatccagctcgacgcttctccgtcatccacggctcacgaagtcgaacggttcggcctcataccgaccagtgataaacagagcgctctgagggctgtgcagacgcagtgtaaactttcagacttggccgagatagaagatatctacccttgcacagaccttcagacaggattgatggccttgaccatcagccagccaggatcctatatcgcaaaacacgtctatcgtcttgcaccacatgtggatattgaccgcttcaaactggcctgggagcaaactattcgatactgcagcaaccttcgcacacggatcgtcctctcgggaagcactgcagtccaggctgtgattcaagagccagttcactggccttccacttacaccgatctgcgttcattcctcctatccaaagagaactgcaccatgacttacgggtcgccgctgtgtcgatttgcaatcatcaagcagggcagcgatcaatactttgcagtcaacatccatcacaccatcttcgatggatggacgttgtccattgtgctacgaacgttgctcgccatgtactcccagacagagccgccatcgattctcccgtataccagcttcgtcaagtacatcatggagctcgaccaggagaattcccgcgactactggtctacccaacttcgtggcgtcaaacgcggcacgttccctgtggtggctacacaaaacaagccgtcatctaccacacaaaagattgccggcatgctagacaagacagtccacctgcagcggccgtcgggctcctccattaccagagctactatcattcgcactgcttgggcgatcttgctggcgcagtacgaacatgacgatgacatttgcttcggcacgaccgtgtctgggcgacaagctgccgtgcagggcattgacgaaatgcctggtctcgctcttgctacggttcctatacgcgttcagcttgacaagcggcaaaagatttccgcccttcttcagtcaatgcaagatcaagcctttgagatggtcgcccacgagcagtacgggctggcgaacatctcaagaatcagcactgacgccaaggaggcgtgcaactttaccaacctcctcatcgttcagccggctcagcagttcactccaactgacagcgggactgaatccaccgtattttatcccgtggctgcggaaggcttcgctgaaggtgagctccttggagactacttcagctatccgcttgtcgtgcagtgtcagctgctcgaaaacgatgtccagctgagtatcatctaccaaactgatctcgtcaaccattctcaagtgaacgcgctggccgagcagttctcctacgttctggagcagctccagaagaatggtgacaagacactgtcagaactctcccctgcgagcccctgggatactgagcaggcaaccaagtggaacagcttcgacattgcaccgatagaagcctgcgtccatgacttgttctccaggcaggttgcaaagataccgcataaagaggctctgtattcaacggccggcagcatgacatatgcagaagtcgatcagttatcggacgagctagctttgcatctcatccaactgggcgtcaaatcggaagccatcgtacccttttgctatgagaaatccgtgtggtccatcattgtcatgatgggcatcatcaaggctggcggtgtcttcctaccgctagacccgagccatccgctcagtcgacgacaagccttgatcgacgaaacaagtgcccagtacatgatcgtatcccctagtacagccaaagagtgtgcgggcatgaccagaaacaacattgagctttcgtcggcctttttctcaagaccaaatggtcgggcctccgcctcacggaaactcaaggctgccaggtccagtcccagcaaagccatgtacatcctgtttacctctggttcgaccggaaaacccaagggtgtcattatcgaacacagggccatatccagcttcctcgtcaggctgtgcaaagttatccatgttactagggattcgaggaccttccaattctctagctatgtgtttgatgcgtcaatcctcgaaatcttcgccaccttgatatcaggaggcactgtgtgcgttcccaccgacgcggagcgcatccagcatgcggcaagcttcatggggcaagcccacgtcaacactgcccttctgactccgacattcgcgaagacacttgatccacagacggtaccctcgctgaagacactgatacttggtggtgaagctccatccagggacattgtggactcgtggcgtcagaacgtcagcctttggaacgcatacggacctactgagacctgcgtcgcgtcctgcctccaacgatacactgacgatgccacatcagccactaccattggtcgtgggtttgctcatcattgttgggttgtcaacccagagaaccacgatgaacttactcccattgggtgcgttggcgagcttctggtacaaggagatgccttgtctcgtggctacattaacgatgaagaaaagacaaacaacgcattcataagtaacgtcaagtggcttcctgataccgttgacgttggaagacgacggttctacaagactggcgatctagtccgatataacccggatggaagccttcattacctcggccgcaaggatacgcaggtcaagattcgaggccaacgtattgagttgggtgagattgagtatcaaattaagctccaatcacatgatgtcgaacatgcggttgtcgacaagatccgtcatgacacccatgagtccctcgtcgcctttgttagcttctccagcgacacgagccccagcgatgcgtcaaacatacgggtattgaatcatagcagcaagctgcaggagctcttctcccagctggcttcagacctctctactgtcttgccgagtcatatggttccccagtatttcattgccgtcgagtccatgccgctcaacacctccggaaagcttgacagaaaagcactcctgcagacggcggcaggtctctcttcggaagacctggcagttcatttggccggccagcgtctacctttccgcgacgtctcaacagacctcgaacactggctccgagcagagtgggcagatgtcctcgaactacccagagaaagcatcagcgtggacgacaacttttaccagctgggcggcgactccattcgcatcgtcaacgtctcgaggcttgtccttgacaagtttggagtgtccctcgggagcaccctgttgaacagcaagcacacgacaatcagcaacatggccaaattcatctcccagagcgcggagaacggggctgcagaggcagatcacccagatgcgcaagtcgacctcatggccaaggttaacgagattgccaactcgccctggatgcagcacccgcgagccctccttgagaatcccacaactacactgcctgaccaagccacggtcttcctgaccggagctactggtttcctcggcaccgagattctcagacggttggttgaaaatccagcaatcaggtcgatagctgtccatgtccgctcgaaaacactagcacaggggatggatcgaatcagagagacggccaagattgcaggctggtggcgtgatgaagatgaagcgaagctggaaatctggctcggcgacctctccaagacgcgtctcggtcttacagaagcacaatggcagcgcctctctggagtgtcagaatcagaagccaacatcgatgccatcattcacaacggagcatctgtcaactggaacgccaactatgagacgctgagcgctcccaacgtcaactcaactgtcgacctgctcatggcaacggccacatcgccgtgccagcccaagtttgtctttgtgtcgggcggtgcctttacggatccagcagagaacccagccgtttccgcagcgcttctcagtggttccaatggctactctcagtccaagtttgtctgtgaagctgttatcacgaagatggccaacagcctccccagcacacagaaccgcgtgtcgacagtcaagcccggtcgtatcatcggaagggccgagaatggcgtttccaacgtcgacgactttgtctggcgtgtcgtctctacggcggcatcgatccaggcctaccccgaggaagcatctgatcactggatggtcatgcaagacgtgggcgtagtcgcatcgaacgtcctcggtccactctttgccgattccatcaagccattcaacctactggcaagaggaatgacaatgtccgacttctgggaccgtgtcaatgccgagctggacgccccgtgcaagccggttacctggcaagaatggactgaacgcgccctggcctcgatgaatacggttggcaacacgcatcccctgtggccggtgcagcacttcctcggtcagctcggtctgccgcgagactttgcaacgctggccaatgcgggaacgcatgtgtgcgagcagtcccagaaggctgtccacagcaacgtgcgttatatgaagaagattggctttatccagtcttcggaggaaggatttggcaatgtacagcgggatggcacgattcgacgcgtgcatacgcttgcaggatga

SEQ ID NO: 145 - protein, 16534 aa, Trichoderma reesei QM6a
MAVLQASKQQTPAATICSYLDPWPKLREWCFDRWDNGAMLQSLATYCATSPAEEPGARGSTNGSIESSKHQCGNTAKQIDVAICGVGLRLAGGIHSIEEFWQALVGGLVAEGSASNAQKSGQLNRSLSAFDARFFTMAADGRIDSDPYSQKLFEVVHECLEDACEVNYRGEKASVACYVAMPGRKDVEAREKGNASTVELVSKQFEFRGPSLTIEDAEDSASLVTLDEACKAVRNGSAQAALVAGINLIATGATADDLEGEAVVAVFIKPLSDAVRDGNPIQAVIRAASSDSSDAEVVECSDVLIAGSSSQPDQGDLKSASGLVSLIKAMASLEHQDVLYSATTLSKAVVVVNVQRLPKPADETPSQKHLDLPSGRAQRIRINFAGKSGHESHFVIEPHRQHESPASNDAAGPQLVLFSANNVTSLNQQMQLHHDFARSNPHLVSDIAYTRAIRREALDHRAFSIIGNDGVCLSTASPAKCPVAPPSITMVFSGQGAQWAGMGKELLRIDAFRNDIKSMDSILRQLKTPPSWTIEEEIQRSASDPLCRINSVETACVVSTALQVALFHQYERLGLKAEAVVGHSSGEIAAAYAAGYLNLKEATVVAYYYGYAAAMSVCDGAMAVAGLSAEETREFLRDGAVVACENSPTSTTISGDRGVVEDIMASIQLSRPQVTTRKLRVDTAFHSHHMETVSAEFLRLLQSEGITSTQQTTRNAVFMSSVSNTILTSAKDFGPHYFVNNLVSPVRFSSAVMSILDTTPTHGLFLEIGPHSTLSGPLSQICSAASLSCNYISSQSRETDCLASLLSAIGRLWQNSVALSLDTLFTGQALSGLPRYPWNYGDDNDSDLADANKMHLSAKDRRAQILKRSASRTPCNLSADETPETDLELILRAIWADVLRNVIQIRVEDIGKHHNFFLLGGDSLTTTELATAAYRHGIRLSPTDVTENPELVRMAAVAVIDDAEEINNAKPFSLISSEDRDDVELNIQRQCRLAAEALEDIYPCTTLQEGFMALGLRQPGSYIHRQVYKVMPHVDLDRFRVSWDTVVKHCGSLRSRIVLVNSQAWQFVVATDTAWDAPVYNVDVNEYLKESRSFTMSYGDCLSRSTLLHQENGDIYFVWIVHHAVFDGLSMKIVLDSLQNAYHSMHSIEPPPPYSNFIRYIGSLDSNRSREYWRKELDGAQRSQFPVASISPTSRDRVFTKSMPFRNSKASITTATIIRAAWALVLAQYCGSDDVCFGMTLSGRQAPVPGLNEIPGPMIATVPVRIHVKRDMLISEFLQHIQSHASHMVAHEQYGLQNISKLGPNAKEHLSSVACSSLNSILQQGPVEKTISEEAMRNYFNYPLVLQTRLGNDAIDLEFTYYDDILNEDQLGALFHHFEHVIQQLLQPDDIPLKSVTSSSQWDLQRVREWNSEEPEIVSSCLHEIIERHALKRPDATAVCAWDMTLTYEQLNLAADRLAHYLISNSAAQVQLGDLVHVCFEKSAWFMISILAINKAGAAWAPLDPSHPVQRQKQIVARTNAKLALTSSSNAALCSELVEHIIEVSADLDDMLIAERRGSKGLPRVSPSAAAYVLFTSGSTGTPKGFVMQHQAVCTSQTSAVRRLGMTSDIRMLQFASYVFDMSIGEIVGPWVAGATICVPSEEVRMNGLVEYIRDMKINWVYLTPSFSRTLNPDTLPGLDLMLLAGEAVGRDVLETWFGKVRLVNGWGPAETCVFSTLHEWTSLDESSLTIGRPVGGFCWLVDPENPHVLAPIGTVGEVVIQGPTLLKEYLADPEKTEAATVRSLPDWAPYRNLADWNRFYKSGDLCKYNPDGTLVFVTRKDTQIKIRGLRVELGEVEHQIKASLEGVCQVGVDMVTTDGGSSLIAFFCFSNETRMVTTVNAAADEGAAMFLPVTSQLKSQIVSMIGHLSVNLPRYMIPSFFVPCKYMPSITSTKLDRRTLKNQIELLGPDGLSTYSLVDTVKNPPETAMESKLQALWAKRLKMPLEAIGRDDSFLQIGGDSIAVIHFVADARQAGISLSVQDVFDDPRLWRVAAIATSADGDSHSAPIVAPFGLLEPGQIDSVMQDELLKLCGLPSWDAVDDAFPCTKLQEGLMALTTKQPGAYVSKMVFKVPRHVDIGHFKASWERTVAVCSNLRTRIVQLSSLDSIQVIVKEPAQWEVTDNQGIDVFLRQANSIRMSYGSRLARFALVHGDNSDCYFVAIMHHLIFDGWTLALMVQALHAIYRDSEVPRLAPYSAFVRYTLQLDFETSKTYWKAQMDGARRAVFPLPRDDIAVAKSKRNVQISAKEVKIPQTTNGTITRATYLRAAWAMLLARYCSTDDICFGASVSGRNAPLVGVESVLGLVVSTLPVRVRLNPDQSLSDFLRDVQKQSNDMVAHEQFGLQNIARIGSDAKDACNFTSLMVVQPKDLTTGSNGNEAILISTREEQRLAWQSMEDYYNYPLILQCHLGDDSVELEFVYDADVISEFQVLALSNQLDHIIQQLASLDKRTLLRDVSRASPWDLQQSLDWNSHEIVVQKHCMHDLISQRAKLCPDDEALFSTEGSLTYAALDRLSDHVASQLLQYNVQPETIVPICMQKSIWAVVGMIGILKAGGAYMPLDPTHPESRRQALVQEVNAKVIVSSPSMAASCESMAPHTIQVSSSLLALAPETPVDYHSLSNYKKPEPHNAAYVLYTSGSTGKPKGLLVTHSAACTSLLKHSDMFNFKKSSRVFQFASYVFDVSVLDIFLTLILGATLCIPTETERMDRAWRFMTKARVTLACLTPSFIRTLDPDTLPTLQTVAIGGEATTKDILKTWHGRVELINAYGPAEACVNCAGHPFKSQDDSPMTIGRPFTHRLFIVEPDNHDRLTPVGCVGELLVEGHAIARGYINNEEKTKASFVDSLDWLPTQTESDRPIAYKTGDLARFNPDGTVEFFGRQDTQVKLRGQRLELGEIEYHIKANLADVQHVVVDLIEREAGKMIIAFVTFHNYLCDNTPTDAEDPYAEFISNEIYVSSFQALIQELRRVLPGYMIPSIIFPMRDVPHTSSNKIDRRTLRELATSMPRERISSFSIARQDKVPPTTEMELKIQSLWAQVLKIDTEDISKFDNFFEVGGDSISAIHLSNLAAREDILLPIANIFKEPQLASMAACMTIRQSQHTDAQPFSMIEATEVESLHASIRRQCGLANEQELEDIIPCTPLQEGLMALTATRPGSYIARRAYKLADGVDLDRFKDSWERTIKACSSLRTRIVQHGDVSLQAVVSHDGLWEETDGQTLQSYMKGLTSLNMGYGSRLSRHAILSCSNGSTYFIWVAHHAIFDGWTMQIKLDVLQRLYAQEPLPPIRPFANFVQYLSQLDPKAAKDYWLMELEGAQRASFPPAKVTTGNKTSTAQKTQIMKRKLANIQTQASEMVAYEQFGLQNISKLSDSAKHATDFTSLFVVQSRQHEIGKSQGELFTTDSNDETSIENWIEDFFNYPLTVECDLMQDQAVMTLYYDADVLSDLQLQGLCNQFEHVLQELNLRYKEPLGNLSMTSQWGIDFAHASNPDKPLVVESCIHTLIEQRTKLNPESPAVSSWDADFTYSELDENADKLATYLLSTLKVKAGDLVIVCFDKSAWFIVAILAINKIGAAWVPLDPAHPTDRHQNIVGQTKATLALCSLANVPKLMGVTTSVLEVNGEFMSRLPLNDAVKPSVKVSPDDVAYIIFTSGSTGVPKGVVIQHRAICSSQVALSQRLEMHDGVRMLQFSSFVFDASLFEIYSPLISGACVCIPSWDTQMNSLPAFIRERNVTWAFLTPSVASIIRPEDVPCLELVTLGGEAPSKEVVNSWLGKVRLFNVWGPTETTVIAMVHEYTATELSHLTIGRPICGNCWIVNPNDPHQLSPVGTVGEIVVQGPNLLLEYLENPEKTAAATVTSLPHWVPNREVFGRFYKSGDLATYNADGTIRYNSRKDGQIKIRGLRVELGEIEHHIRNNLEGPCQVAVEALKFEAGTHLVAFICQNTDTIPASMTGDVATEDIFLPSTADLRSDLEAMHGFLASALPSYMVPTFFIPCKKMPLVTSSKMDRKLLRRLAAALDRQAFEQYSLYAVTEAKSSPETPMEHSLQQLWADVLKVPAESIGRHDSFLAIGGDSIAIIRLIALAREHGIELRANDIFKDSRLSSVALNAAPIEVDSSSANSAISAKPFALLEPHIRDALLAPRLRKELKLTRSMKIEDGYPCTNLQEGLMVLAVKQPGSYITSFHYRLAENVDPSAFKAAWDKTVRLCGILRTRVVHLKGSSVQVVISDYTWDDTKGMTLKSYLQSIEHLEVEYGSRLCRYALIKDENNQTHFIWTMHHAIFDGWSIRVVLATLDNVYKGMKTTALTPYSRFIEYTLAINPQSAADYWVEQLWDAKKASFPPNTSGKLPEYSNGYRSMVTNIKLPDLSATGFTRATILRATWALLLTRYCETDDICFGTTISGRQAPVSGIIDMPGPAIATVPLRIRVPQQKSVAAFLQEVQEQALAMVEFEQFGLQNISKLHACAKEACDFSSLLVVQPKEALDPAGDQDAILIAADGKVETGEYALQNYFSYPLVVQGHLYDESTELVLIYNSAILPEEQIVALSHQFHHVARELVLKLQSNVGSIATTSSWDLQQAMKFNSEVPEAVDGCFHQLFERQARQTPDAMAICAWDGSFTYAELDTAANRLAYHLISQHAIKPDELIHVCFEKSAWYFVSILAINKAGAAWVPLDPSHPLERLGQIVKQTKAQMVLISESHASLCKDLIPIVIEVSASLDQQLSRNGAAFSQNPPTTKVSPANAAYVLFTSGSTGVPKGLVMEHRSVCSSQRAIVRRLGLHSKVRMLQFAAFVFDLSIGEIVAPLISGACVCVPSEQARMNDVAGFIRDASVNWAYLTPSFVRVLKPEDVPGLELLLLCGEVTPRDVFDVWVGKLRFISGWGPAETCVFSTLHEWQPQDSPLTVGRPVGAFCWIVDPERSDQLAPIGTVGEIMLQGPTLLREYLDDAERTASSTVTCLPDWALQKASQWTRFYKSGDLAMYNPDGTIEFCSRRDTQVKIRGLRVELSEVEYRIRESLEGICQVAVDISTSDGGSRLVSYLCFTEETRSSTSSENSMDDILMPITVEVRPLLAAMVGKLRVSIPNYMIPTLFIVCRYMPSITSTKLDRTALRQVASLLTQDQISMYSLSDDNKRPPETDMERKFQSLWASILSIPADSIGRDDSFLQIGGDSISAIHLVSTARAEGLVISVKDVFDDSRLLAIAAKAVFSGKAEGRDNQIAPFSLLPPPTRDAIVMQAAEQCGIAQSAIDDAYPATSIQEGLMALSVKQRGSYVAKYVYRLASQVDIGRFKAAWMKTVELCGALRTRIILFDDSSIQVLLKDPASWEATDKETLSSLVRSDRGLQMSYGTPLCWYATVQEADTSYFVWSAHHAIYDGWTIRLILSTLESIYRNVEPSPLQAYNAFVKYTLSLDHDAATNFWANELQGSKRASFPPLNGTNMGTDGQPTQVHRRTIALPVRERSSITKASILRAAWAIVLARYCDSDDLTFGTTVSGRQAPVPGLEAMPGLAIATIPVRVHLDSQMKTSEFLLGVQNQTTDVIPYEQYGIQNIANVSSDAREACSFSSLLVIQPPASSQADSEEAILLAGEAESALTEDTMDSYFNYPLVLIYGIAGDNVEQRLFFNPGVLAEKQVEALSYQIEHVVQQLANDVCLGDISLVSDWDVKHARDCQTLKLPVQSCTHWLIQDAIRTYPTSPAVVSWDGELTYSELGSLVTRLAAKLRQLGIGRETFVPICFPKSVWAVVTMVAVELAGGAFVPLDPKAPRTRISSVLDDIKATIALTSPCCASVMSGLDIPVVVIDDSFVATLPEAATPVQQTDCPSDAAVVLFTSGSTGRPKGMVIQHDTLCSSANAYGSDLLIGPGSRVFQFSAYTFDVGILDTLVTLMRGGCLCIPSEEDRLNDLSGAINKTQANWVFLTPTVADLLNPADVPTLRVVCLGGEAINQKTAARWKDHVELHGLYGPAEASICAWNPTVGRSGKSTNLGKPLASAFWVVEPTDIHRLAPVGCIGELLIQGSLLARGYLNVDEKQAANWIEYFTAGWLPHDFPNRAYRTGDLVRRNADGTFDYIGRKDTQVKLHGQRVELGEIEHQLHQVLPAGMSAIIDVVKSVDEQRQDSLMAFLWYTDSATSNSPSPLELIGSLSDEQRILISDVDMSLSTTLPSHMIPSCYLIFHGKPNQTTSGKVDRRSLLELAQNISYDDRSRFGPGNEEKETPTEPMEFKLRDLWAEVLHVNAEDISKRDSFMRIGGDSISAIRLVTLAQKHGLALSVATIFHKPQLEQMAHAVSVTANSLVDDIQPFKLVSSIPKEAIIQAVRDQGSLSHAVDAYPCTSLQEGLMALAVKQPRSYIAKFVYRLPDHVNVDSFKTAWAKTVEICTSLRTRIVYVNETPIQVVLNDEPAVDGRDVEEAIQLHRSVEMGYALRLSLGTIVKQNDGRCFFFWSVHHAVFDGLSNRNIFTVLQKVYSGLEVSPLPSYARFIQYVKSLDVDNAGRYWNAQLENCEHSNFPATNGIPNSETTTSILEKVVDLPKMPKSNITTATLIRAAWALVLSRYCSTDDVCFGMSLSGRQAPVPDVIDMVGPTLATVPVRVRLDFDQSVSCFLEAVQDQALEMISFEQYGLQNIAKLGPDAKQACQFSSLLLIQPTETENEEGDNVLVTADVEVESPADMVHKFYSFPLVVQAHLGDDSVRLSIIYKSNALVEAQAEALAHQLSHVVCQLTSLRFAPLRAVTLASSWDLEKAISFNQEIPDFIDSCIHTLIEAQAEQRPDAIAVSAWDGELTYSQLNSAANRLSHHLIDRYSLQIEDLVHVCFEKSIWHVISVLAINKAGAAWVPFDPSHPEQRLRQIVSQTGAKLALASSGNAALCGKVVERVLEVNSASDDQLVSKGISSDNPSIPVTPRNAAYVLFTSGSTGTPKGIVLEHAAVCTSQTALSKRFGLKSNDRMLQFTAFTFDPSVTEIFATLMLGACVCIPSDWTRMNDLATFINQNSVNWTLLTPSFLRTLSPEDAQSLEALVVTGEAPTLDIFNTWIGKVRLINGWGPTETCVISSTHEWQSAEESYLKIGKPVGSCCWIVDSKHTSQLAAIGVVGELVVQGPTLLREYLAAPDKTKEAVVTDMPSWVPRQGLVGWNRLYKTGDLCYYNPDGTIQYCSRRDTQIKIRGQRIEAGEIEHRISQALSIHQVAVEVVNTDNGHTLVAYICFTSELRKISSTATADEVFAPLTDDTQRLISEAVAQLRTSLPLYMIPTLFITCKFMPSITSVKLDRKSLRQFTAMLDRDQLTGYSLTDAAKEPPSTEMELLLQSLWAEVLSIPAESIGRHDNFFQIGGDSVVAIQLVSIARKIGFPISVTDISDDPRLHAVATKMALADGHVISSDEVPPFSLVPQSIHKAISGGDAELQCKLTEGQAIEDAYPCTPLQEGLLNTTLKQPGAYIARFRYRLGEGTDVSRFIAAWNRTVEACANLRTRIIVINNSTIQVVVRNGCRWNDEEKTMLPSHGQQDLEVDYGLPLCDYSLIEHDGANYFCLRLHHSIYDGWSVPLMLSTLQSYYTALDVSPLYPYSRFVKYIMGIDSDISAEFWTSQLEGAKPMSFPTVSEGGKIESKQTRLQSITVGIRQSSNSSITKAAIIRAAWAIVLARYSGVNDVCFGSSVSGRQAAVPGLESIPGLVVATVPIRVQIDDQQSVSTFLRSVQNQAFDMIPHEQFGLKNISNLNDAAKAACDFKSLVVVQPVQKLTHESNLLSFATDLEGSSKVEMLQGYLSYPLVAQCMLADDSVDLDLYYDPSVVPEHQVQGLSHAFKHVFEQLLVSPNQSLSQMLAEVPWEVDFAASANGVPPTTIERCVHSLIEDETLKHPATLAVDACDARFTYQQLDICANRLSHHLINNFHVKKGDVVHVCFDKSAWYIVAILAINKAGATWSPLDPTHPVQRYQQIISQTGAELILASPTNTSKCTNLTPFVLEVSSRLDQALSTKDVLKHRPNVDVSPSDAAYIIFTSGTTGMPKGVVIEHGSLCTSQTALALNVGLTDQSRTLQFASFVFDACIFEIIATLLVGGCICMPSWDEQMNNLTGYMVKASVNAAFATPTVARSLKPEDIPCLQVLLVGGEAAASDIVSTWFGKLRLYNAWGPTETCVIASLHPWTGPNDSPRTIGRSILGNWWIVDPNDPRKLVPTGCVGEIVYQGPTLFREYLANPAKTDEVIVSSLPYWVPNRELRGWDRFYRTGDLGHYNPDGTIEFAGRKDTQVKIRGLRIELHEIEQQIITNLSGARQVAVDVMKRDEASQLVAFYSFSNETLSSHLGTGPDGKAIFAPLDNNAAPQIHDLISLLKGVLPPYMIPTTFIPCQHMPIGTSTKLDRKLLVQMATSLSREQFEQYSLVGSTKRALETTMEARLQQVWADILHIPAESIGRDDNFLQIGGDSMSVILLVSAARESGISISARDVFQDARLLSVAAKAEVIADDDDDFGDVEPFGMLEEAELDFLQTDEAKSCLGLSHSMSIEDAFPCSKLQEGLMALAVQKPGSYIGTFHYRLSKSADIDSFKAAWQRTVEMCPNLRTRILNIDGASIQVVLQNDFEWESTQEGSLDGFLEASRDIRMEYGSRLCRYALITQDGSTRFILTMHHAVFDGWTMRLVLETLDSAYHGDAVAELSPYSRFIQYTLDSDQASASEYWLSQLRNAKKASYPNRLTPGEQPANANSTGYLESEMQIPKISAGTTKATILRAAWAIVLARYCDANDICFGTTVSGRQAPVPGLAEMPGPVIATIPVRIHLEDGGKPISDFLEDIQSQAMEMVAYEQFGLHNIAKLSDDAKDACDFSSLLVIQPRQILSHINGAGDALLVARSDESADEALESYFTYPLVIQAHLHDDGDKLVFIYNKFSLSEQQLITLSHQFQHVVSQLASHPDLLLKDLSITSEWDVKQSVEFNSEVPEIIDSCVHKLIEAQAHRAPNALAVSAWDGDLTYSQLNKSANRLARHLVKNYDIRPDDLVHVCFEKSLWHFVAIVAINKAGAAWVPLDPSYPEQRLRQVVDQTRATLVLSSARNEKLCSTLLENVVRLDDKLDQRLAVTENGDEGPAVAVTPNHAVYVLFTSGSTGKPKGLVMEHGAVCTSQTAIAKRLNLTSEVRMLQFAAFVFDLSIGEIIGPLISGACICVPSEDTRMNGLKEFVNDTKVTWAYLTPAFVRTLVPEDMPALQLLLLAGEAVPRDVLTTWFGKVRLVNGWGPAETCCFSTLHEWSSVDESPLVVGRPVGGFCWIVNPEDPQRLTPTGTLGEIVIQGPTILREYLADVERTKDSTVYSLPTWAPRPDSKNWNKFYKSGDLGYYGPDGTIVFSSRKDTQIKIRGLRVELGEVEHYVREILDGVRQVVVDVYQKEGRSNLVAYICFSDEMKNPSADELFTADGLFAAITTDLRQRIAIMLGELRIALPTYMIPSLFIPCRFMPSITSTKLDRKTLRHLMDSLNDEQRNAYALLNSQKREPETEMEIQLQALWADVLGIPAASIGRDDSFLQVGGDSILAIQLASRAREMGISFQVKDVFDDPRLVALSLKATKTTDQLETHVAPLSMVTDRLRDAVFSDDVRKQCCLSEEQVIEDCYPCTSLQEGLMALTAKQPGSYVANYVFRLPRHVDISRFVAAWNQMSDICSNLRTRIIHLDGESVQIVVRGGNQWRSTENQTLSSVLDSSENLKMTYGTALSSCAIVHDGDSDYFVWSAHHSIYDGWTMRILFSTLYSAYYGDSLSPVRPYSSFINYYRNIDTGKAAEFWTKELAGSKRAEFPTSQRSISAARTDVYHSTIVLPETLNIPVTKATVVRAAWAVVLARYCDTDDVTFGTTVSGRQAPVQGVESIVGPMIATVPVRVRLDKNGPVSQFLSDVQSQASSMIPYEQLGLQNIAKLSSDAKEACEFSSLLVIQPPAHDPAGGDDSKAILSHSETEQDETEKAMQGYFNYPLVIISGIGEKAIEQRLFYNSDVLGKDQIEALSHHIEHVTHQLLNNSGMQKDISLIGSWELQKAVDASRLRPATESCTHWLIQDQVRLQPDQIAISSWDGDLTYAQLGKHVARLAARLQELDVGPESLVPLCFHKSKWAVVAMVAVQMAGGAFIPLDPGASPARLQGILQDTGATLAITSSECQGLLQSLGMKAVTVDDQSISELPAEFDLRSEARPTNASVILFTSGSTGKPKGMIIEHRSICSSSDAYGADLKIEAGTRVFQFSAYTFDVGVLDCLVTLMRGACICIPSDHDRLNNLAAAITASKADWVFLTPTVADLLNPVEVPTLKTVCLGGEAITKKCADRWVGHVSLHGLYGPAEASICAWNSVVGRSGRPTNLGHPISSAFWVVNVNDPKSLVPIGCIGELLIEGPMLARGYLNVTAEVAANWLEGVDWLPGDNRPRRAYRTGDLVRRNADGTFDYIGRKDTQVKLHGQRVELGEIETRIQEFLPQNMAAIVDVVKDNDAPATLLAFIWNSDGSSASPARLVDTVSDEARAMVLHLDTSLNTILPSYMIPSSYLLFSGKPEQTTTGKINRRSLTGQAQHITAQERLRFAPDTSFRVLPTTPMEFKLRELWAQILRIEPDDICKNDSFLRLGGDSISAIQLVSKAQLQGLDLTVATIFQSPRLEQMASAIVEDELTVYSEIRPFDMLPAGESSTILAEARDQCSLPDSAIIEDSYPCTKLQEGLMALSVKQPGSYVAKYLYRLPDHVDVARFKSAWKQTMHICASLRSRIINTSAKSTFQIVLNPESSSEPLPYHDLQAVLRYAQTIKMTYGSALCQFAFVEDEQRSVFFFWAMHHTVFDGLSTQVILGILHKAYFGLETPVLTPYSRFIQYLLQIDEEAASAYWRDALHDAKPAQLPSLHNTHDKVVATCVLETPIGFVDASKLNVTLATVIRSAWAIVLARYCDTDDVCFGIATSGRQAPVPGIVDMVGPVIATVPVRVRLDRQQPVSDFLQSVQQGAVGMIPYEQFGLQNITKLSRDAYEACQFSSLLVVQPIRHIANSEESKELLSAAEVTEGLSDSLNNFFNYPLIVQGHLYGDKVKIAVAYDRNVLTERQVQALSEQLGHVIHQLASGAGTSLESILIASSHDLELALAVNSEVPEIISSCVHELIDKQAQISPQAPAILACDAELTYSDLAAASDRLAYHLIHSHGVKPGDFVSVCFGKSAWHFVSIFAINKAGAAWVPLEPSQPEARLRQIVLQTKARLALVSPSNAELCAKLVTDVVEVTAELDQQLGRSVSEPFKPLAISPRSPAYILFTSGSTGTPKGFVIEHQSLSTSQTALATRLKMTSSVRIMQFASYVFDMSLGESIGPLISGACVCIPSDRERMENIATFIRKRQINWAFLTPVFARTIQPADVPSLELLLLGGEAVPQDLCLTWFGKVRLINAWGPAEACVISAVHEWTSAETSSLVIGRPVGGFCWIVDPEMPQSLAPFGTMGEVAIQGPTLLREYLDEPERTKAALIPRPSWAPQPDAQHWNRLYRTGDLCFYNSDGNLVFGGRRDTQVKIRGFRVEIGDIEHHIRDKLDDVCEAAVEVLKSTTGASLIAFVSFKSGIEQPDIESSGSSGEVFLQPTSRMQKAFRALEGRLKATLPPYMVPSIFVPCKYLPSTTSDKLDRKKLKAMASSLSLEDLSKYTLSDLEKQGPETEMEKRIQLIWAELLNVPATSIGRDDSFLQIGGDSIIAIHFVTAAQNSNIGLSVADIFDDPRLLAVAAKAISLTRSGQAAEIPQFGLIDEQTQQLLSSQDLRQNYHLADDVVLRDAYPSTKMQEGLLALTEKQPGSYVAKFVYRLGRTVDVLRFRSAFEDMVKLCDNLRTRVVMVGSQTVQLVLENDFAWDEVQGQELQSYMHALGSSNMAYGSRLSRGAIVMDGDEVYFVWALHHSIFDGWTMRLMMDVLHSMYDGRSPPSLQSYNRFVAYVGNLNHEETRNYWGAQLDGASRAAYPPLSKTSSNSSKSLERGMQLPNMTDLSATKATVIRAAWAMLLARYCETDDVCFGATVSGRQAPVPGLPDMPGPAVATVPIRVRLDKHRSVSDYLDTIQSQALKMIPYEQFGLQEIQKISPRAQEVCNFSSLLVVQPMQHLINGEHALLQPVEVESQEESSLQNYFTYPLVIQGHVMGEDIKLMFIYDSNVLPESQVLAISHQMEHIMRQLIAKPQSLLGDLSLTCDWDVKFAEKANREDPPEIIDSCLHDLIECQAEIRPDAVAILGWDKVLTYDELNKAANRLAHHLVMDIGVKAHDLVQVCFTKSAWYAVAILAINKVGAAWVPIDPSHPLQRHQQVTAQTKARVALASQDNVERCSQLVTSVVVVSSSLDSDLCKKGFSSSQGPDVLVTPKHAAYVLFTSGSTGVPKGLIMEHGALCTSQMAAGKRFGFTPSVKILQFAAYVFDYSISEMLAAMMYGACVCIPSEEDRMNRLKEYVNDTGINWLFLTPSFLQTLRPEDVPSVELVALGGEAVPRALFEEWIGKVRFFNAWGPSETCVMSAMHEWRSSEESALTIGKPVGGFCWIVDPEDPWKLAPTGTVGELIVQGPTLLREYLGDAEKSKAAILEGRPDWAMYPDTQHWTRFYKSGDLCSYNPDGTIRFYSRKDTQVKIRGLRVELGEVEYRIKETFPEAHQVVVDVFKSGSVSNLVAYFCFGDATVDVSSNSLDDIFMVLGEETQQRLATMVGELKVLLPEYMVPALFIQCKHMPTATSGKLDRKTLRGLTSSLTKDQLAAYSLVNSKKTMPQTPMEGKLQAIWADVLGIPMETIGRDDSFLSIGGDSIAAIRLVAAARDQGVALTVSQIFEDGRLLSIASKASFISDGSSQAFTPIEPFALLDEPQRDMITESAEEFGLELSRDMAVEDCYPCSKMQEGLMALAVKQPGSYIAKYNYRIPSHVDVSLLKAAWEQIVNSFPNLRTRIIRLGAISLQVVVKGDTVWDSTERMTLRSYLQQTRTMEMGYGSRLCRSAIFKDGDEVYFSFNLHHAVYDGWTLSIILEEFHRAYKGLEPATTVPYSHFIKYTMELDHEAAGDFWARQLENARKATFPSVPITSTSKPEASRTMTAELELSKSNTTITTATIVRAAWALVLARYCDSTDVCFGATVSGRQASLPGLTQMPGPVIATIPVRIHLDHDQPTTKFLEEVQTRASDAIPFEQFGLQSIRKLNPDADEACDFTSLLVIQPLKMLSHLENTGEDALLVGVEDTDDSADGMQNYFSYPLVLQAHLSDDFMRIVLIYNPHCIAEQQIVALSEQLKHVIAQLAESKPSQMLRDVSLVSQWDIEQSRKFNVDTPEIVDSCFHTLVEDQAAQRPDAMAIRSWDGDFSYAQLNQAANRLANYLVQTHEIKTNDLIHVCFEKSVWHFVSILAINKTGAAWVPLDPSHPLQRLQQVVSQTRAKFALCSPDNSDLCSTLVESAIQITPEFDKQLQKQVNSRQGPTERASSGDIAYVLFTSGSTGTPKGLVMQHGSVCTSQKAIAKRLRLGPEVRMLQFAAFVFDLSIGEIVAPLITGACLCIPSEHARMNDLSKFMQDMNVNWAFLTPSFVRTLNPDDVPGLEVLLLAGEAVPRDVLTAWFGKVRRLINGWGPAETCVFSTLHEWKSVDESPLTVGRPVGGFCWIVDPDSGFLAPIGTVGEVVIQGPTLLQEYLADPERTNTSILPAAEWAPRPDESHWNRFYKSGDLCRYNADGTIEFSTRKDTQIKIRGLRVELSEIEYNIQQSLIGVRQVAVDVVRGDNGSSLVAYICFTDETKTAGVKTDASETLFLSTDESLQNQLIALVGELGIALPRYMIPTLFIPCAFMPFIASTKLDRKLLQTHLSTLDRDQLAMYSLLHSEKRQPETEMEQRLQLIWAEIMNLPMESIGRDDTFFQLGGDSIMAIYLVSTAKEEGITLTVQDVFDDPRLLAVAAKAVLSQDGMEPADSPPEPFSLLPEAQKRLVLGEDARKLCGLAKDRTITDAYPCSSLQEGLIALTAKQPGSYVATYAHHLSSFVDIPMFRAAWDSVVDICDNLRTRIVVLDGVMTQIVLDRDSQWVPADNETLESMTGSSRNLKMGYGTPLCWYSIVSEKGENYFVWSAHHSIYDGWTMKVMFTALFSAYQGMYAPEVRPFSSFIKSVKELDNDKVASYWTQELAGAKRASFPSRRTAPGIMESKRFSSTIPFSRSMKTSITQASILRAAWAIVLARYCDSSEAVFGATVSGRQAPIPGAEMISGPMIATVPIRARLDNQAPISRFVQDIQSLSTSMIPYEQYGLQNIAKVSAEAREVCDFSSLLVVQPPAHGAGDDHGESIFVVDASASDLTMDSMDGYFNYPLVIISSLYPEEFRLNFFYDSTVLSEARVIALSSHLNHVIQQLVAKEAVNAPLSSVSLLSPWDLQQAVESSRLEPSSNTCTHWAIQENIQSRPDDVAIASWDAELTYSQVGTFASRLAIELQERGVGPETLVLLCFPKSAWAVIAMVAIEMAGGAFVPLDPAAPAARLKGIIEDTHATLAMSSPTSGKVLEGLGVDVFFVDEEMLSGLPSPTKPVISNVRPDNASVILFTSGSTGKPKGMVIEHRNLVSSSDAYGNLLGIGPGTRVFQFSAYTFDVGILDCLVSLMRGACLCIPSDHDRMNDLAGAMRSSKANWVFLTPTVADLLSPTDIPDMKVVCLGGEAISKKCADRWVHHVDLHGLYGPAEASICAWNPTVGKLGRSTNLGRPISSAFWVVEPGNLRQLVPVGCVGELLIEGPMLARGYLNVSPEVAASWMEDVDWLPGGRKRVYRTGDLVRRNADGTFDYMGRKDTQVKLHGQRVELGEIESRIHELLPDNMAVIVDILKADDENAHDILLAFLWYTDDEMTSRSEALQLMHTVSEQAQSVISRLDLALEESLPSYMIPSSYLIFEGKPEQTTSGKVNRRSFVELGRSVSVQDRLRFTPSASDYVSPTTPMELELQSLWAQVLKISDVSAIGKHDSFLHLGGDSISAIELVSFAQRQNIGLTVAMIFNYPRLSAMAEAIQLDASPSSTAHEVERFGLIPTSDKQSALRAVQTQCKLSDLAEIEDIYPCTDLQTGLMALTISQPGSYIAKHVYRLAPHVDIDRFKLAWEQTIRYCSNLRTRIVLSGSTAVQAVIQEPVHWPSTYTDLRSFLLSKENCTMTYGSPLCRFAIIKQGSDQYFAVNIHHTIFDGWTLSIVLRTLLAMYSQTEPPSILPYTSFVKYIMELDQENSRDYWSTQLRGVKRGTFPVVATQNKPSSTTQKIAGMLDKTVHLQRPSGSSITRATIIRTAWAILLAQYEHDDDICFGTTVSGRQAAVQGIDEMPGLALATVPIRVQLDKRQKISALLQSMQDQAFEMVAHEQYGLANISRISTDAKEACNFTNLLIVQPAQQFTPTDSGTESTVFYPVAAEGFAEGELLGDYFSYPLVVQCQLLENDVQLSIIYQTDLVNHSQVNALAEQFSYVLEQLQKNGDKTLSELSPASPWDTEQATKWNSFDIAPIEACVHDLFSRQVAKIPHKEALYSTAGSMTYAEVDQLSDELALHLIQLGVKSEAIVPFCYEKSVWSIIVMMGIIKAGGVFLPLDPSHPLSRRQALIDETSAQYMIVSPSTAKECAGMTRNNIELSSAFFSRPNGRASASRKLKAARSSPSKAMYILFTSGSTGKPKGVIIEHRAISSFLVRLCKVIHVTRDSRTFQFSSYVFDASILEIFATLISGGTVCVPTDAERIQHAASFMGQAHVNTALLTPTFAKTLDPQTVPSLKTLILGGEAPSRDIVDSWRQNVSLWNAYGPTETCVASCLQRYTDDATSATTIGRGFAHHCWVVNPENHDELTPIGCVGELLVQGDALSRGYINDEEKTNNAFISNVKWLPDTVDVGRRRFYKTGDLVRYNPDGSLHYLGRKDTQVKIRGQRIELGEIEYQIKLQSHDVEHAVVDKIRHDTHESLVAFVSFSSDTSPSDASNIRVLNHSSKLQELFSQLASDLSTVLPSHMVPQYFIAVESMPLNTSGKLDRKALLQTAAGLSSEDLAVHLAGQRLPFRDVSTDLEHWLRAEWADVLELPRESISVDDNFYQLGGDSIRIVNVSRLVLDKFGVSLGSTLLNSKHTTISNMAKFISQSAENGAAEADHPDAQVDLMAKVNEIANSPWMQHPRALLENPTTTLPDQATVFLTGATGFLGTEILRRLVENPAIRSIAVHVRSKTLAQGMDRIRETAKIAGWWRDEDEAKLEIWLGDLSKTRLGLTEAQWQRLSGVSESEANIDAIIHNGASVNWNANYETLSAPNVNSTVDLLMATATSPCQPKFVFVSGGAFTDPAENPAVSAALLSGSNGYSQSKFVCEAVITKMANSLPSTQNRVSTVKPGRIIGRAENGVSNVDDFVWRVVSTAASIQAYPEEASDHWMVMQDVGVVASNVLGPLFADSIKPFNLLARGMTMSDFWDRVNAELDAPCKPVTWQEWTERALASMNTVGNTHPLWPVQHFLGQLGLPRDFATLANAGTHVCEQSQKAVHSNVRYMKKIGFIQSSEEGFGNVQRDGTIRRVHTLAG

SEQ ID NO: 146 - DNA, 1799 bp, Trichoderma reesei QM6a
  CDS (1)..(279)
  CDS (876)..(937)
  CDS (992)..(1796)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45201.1 (111418)
  ref <309>: DATABASE ENTRY DATE: 2006-10-18
atgcccaacgggttcagtgaaaatcgtaggacgatcaacgtcgaggctgggcagcttccgccacccgcaaccaagctcatcatcactcaggtactcaaggccagtcaggatcccccattctgggcgtggatcatcgtgggggcgttttacgacagcgaaaaccgcattctctggagcacagagctgtttgccgcgcaccttgatattcagtttgagtcggacgaggagcaactctccgaggcggaggcagaggaagaagaagaagaagaagaagaagaggtagaggaagaggaagaggaagaggcagaggaagaggaagaggaagaggcagagacgggggctgcgcctgagccggagtttggcgccgaggctgaagctgatgttgagcttcaagacgggtccgaatctgaatcaccgcctggtaagccaattgttgactctgagtctgagtcgccatcacgccgcttttcatgaagctaactcggttgtacaagttcaatctacggaagttcatcaatctgtgactcccgacctgcggcatccatgccctgatagcgcatacaacagccgccatatcgacgcatacgagcgctataataggcactctccctcccaccctacgaattatcttcatcgcctctaccctcatcttcaccattatttctctccgcactcttatcctcacggccaccatagccctcagagccctcgaggccctcatcacactcatagccatcacagccctcacggcttttatagcccttatagccctgatacccgtccttccttccaccaccaccaccaccaccatcaccatcaccaccggccttctccacactggctctctgcggtgccgttcatacatcccccaacagcctggcaccctgccttgtctggccctgtacccggacactggcacgcatccttcgatccttcggtcggacgctgggttcacacttggcatcctcggccgttgatacccttccggtagccagtcctctcgttgcatttcctctcacacaccctcgccaaccatgtctggcggatggaacccgctgaccggccgtgactccggctccggccggccggcctttgctccgtacggagcccctcaagtggcccagggccaagcatacattcctcatgctggcggacctggctacgcctatggtacagtgcctcagcccagcgcgtggcctagcatgacttacggatactatcctctaggaggcgctccgggcgttcctcaatatgccgtacccggctaccccccctttcagcaggcacctgctgcgggcttctacacgcagcagagcttctcctaccagcccaacggcacgggcaacatgctcccccgccatccccagccgtaccccaacatcgattccaccatgccggccgcccagatgaccaacacgacgggcggcacgggctgcgagccgggctacaactacttcttccccgcggagcacacaaaggcgcacatcttcaagacgaacacgccgccgtggcagctcccgccgacggcccagatccccttcaaggcggcgcacatcccgtgcaacacgaccatggcggagctgctcaagggcttcgggtgcaccaacgcgacgcccaagaagaaccggtgcttcgaggtcgtcagcggcggaggaggcaagtggtacaaggggctcgaggtcaacggcgcggacaaggacatgctcaagaagacgatcaaggacgtgggctgggatgctacgaggacgggcaatcccaatgaaaagcccgtggtgtgtttgtggttttgcagggactga

SEQ ID NO: 147 - protein, 382 aa, Trichoderma reesei QM6a
MPNGFSENRRTINVEAGQLPPPATKLIITQVLKASQDPPFWAWIIVGAFYDSENRILWSTELFAAHLDIQFESDEEQLSEAEAEEEEEEEEEEPGTLPCLALYPDTGTHPSILRQSSRCISSHTPSPTMSGGWNPLTGRDSGSGRPAFAPYGAPQVAQGQAYIPHAGGPGYAYGTVPQPSAWPSMTYGYYPLGGAPGVPQYAVPGYPPFQQAPAAGFYTQQSFSYQPNGTGNMLPRHPQPYPNIDSTMPAAQMTNTTGGTGCEPGYNYFFPAEHTKAHIFKTNTPPWQLPPTAQIPFKAAHIPCNTTMAELLKGFGCTNATPKKNRCFEVVSGGGGKWYKGLEVNGADKDMLKKTIKDVGWDATRTGNPNEKPVVCLWFCRD

SEQ ID NO: 148 - DNA, 4086 bp, Trichoderma reesei QM6a
  CDS (1)..(1710)
  CDS (1786)..(4083)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR45203.1 (68889)
  ref <309>: DATABASE ENTRY DATE: 2006-10-18
atgacagacacgtcgctggatgtgcccgtaacccgtaacaagctggaccggaaccgcttctccatcaccggtgcggcgaatctatcgcttgacgatgtcgaggccgtacatgttcagcttcgcggactctcaatttcggtcgacacttcaccgtcatggttggacccctcaacgtatcctgaactattttccgccgggttcaattcgaagcctcgcatcaagactcttctgcattcagttgatgcagacctgaagcccggaaccctgacagccatcatcggaggcagcggctcgggaaagacgacgctgctcaacaacctcgccgagagggttgtgagctcaagactcagccaacaaggcctggcgacattcaacgaaaaagtcggcgtcaacagcgttcgacatgcctatgtgatgcagcaggacattctgctcccaactcttactgtccgagagaccttgagatactcggctgatcttcgactgcccccatccaccagtgccgaggatcgtgaaagaatcgtcgaggaagtcattctcgaactgggcctcaaggaatgcgccaacacccgcataggaaacagtcaacaccgaggttgctcaggaggcgagaagagacgcgtgagcatcggtgtgcagctcttggcaaatccgtccgtcctgtttctcgacgagcccaccactggcctggacgcgacaagtgcctatcaactcgtgcggactctcaaagcgttggcgcaaaaaggcagaaccgtcattaccacgatccaccagcctcgatcggagatatgggacctcttcgacaatctcatcatcttgtccagaggcagtcccgtcttctcaggccccgcctccgactgtcttccatggttccaacatctcggccacgaactgcccccatttgttaacccagcagaattcgtcatcgatgttgccgccgtcgacaaccgcacccctgagctggaggcagaaacctcagctcgcctcgaaagcctcaaagcagcatggaaggtagagagcgaaagccggttcccacctttggaggccgctgccgaggtgaggacgcggcagaagcacccacaggcggcaacacacgccggcttcttccgccaggtacgaatcctgacggatcgaacgttcaaagtcacgtatcgggatcccctcggcatgactgcgtcccttctggaggctgtcatcatgggagttgtcataggatatctgtttttcgacctcggccgcgatcaagcgggcattcggtctcgcgagggtctcctctatactgcaacgggactccaaggctacttgatcctcatgttcgaaacatatcgattgaccattgatatgccgacgtttgaccgcgagtcctcggagcattgcgtcgatgccgtgccctacatcttgtcacggcgattggcccgcctcatcacggaggacttccctgtcccttttctattctccctcatcttgtactttatggctgggttcgatcacgatgcttccaagttcttcattttctttagcatcggattcgtcaaccattttgcttgtatcatgtgtgcattcacatgcgtggtggcagtgcggcactttccaggggccagcctgattgccaactttgctttcacgctgcagagtatcgcgtgcggtatcttcatccaagttgatacgatcccggtgtatgtgcgatggttgaaatgggtgacttggtcggtgagtaaacatctttcctccactctcgaatctgaggtctttggtctgcaatatgctgatcatagcgtgtaacagttttacacgttcggggcgtattgcgggaatgagtttcaaggcagcttctacgactgccccgagccaggggggccatccaacccggcctgtctccagtataccggagactacatcttgtcgtccctcggatttcccaagaactgggtcgctcgccccatcgtttgcctcgcgtcgtttgtcatcttcttcttcatcctgtcggctgttggcttgcagtatatcaaggttgaaatgaccattgcgcgggcgcgagtctcggacacggacctgtcagccggaaaagagaaaatgactgcgcggtcgattgcagaggtgcgcaccatcgatgttgagctagagaatttctcactggatctcgataaaagaaaggtcaatggaaagaagttgcctcggaaaaccattgtccagcctatcaacgtcaattttcaggccggcacgttgaacatcatcatgggcccgtcgggaagcggcaagacgtctcttctcaactcgatggcacttcggctgcgcaactccattggcacccactatcgtccatctggcaagatgtctttcaacggagcagtcccatctgcctctgttgtcagatcagtctgctcttatgtctgtcaggatgacgacgctctcttgccctcgttgacggttcgagagacgttgcagttctccgccgctctgcgtctgccttcgttcatgagcaaggaagagaagagtcgccgcgcagaggagattctcatgaagatgggtctgaaagactgtgcagataatctgattggcaatgacctggtcaagggtatctcgggaggagaaaagcggcgagtctccattgctgtgcaggtcctcacagatcctcgcatacttctcctggacgagccaacgtctggactggatgccttcaccgcgagttccatcatggaagttctgcaaggcctcgcaaacgaaggcagaacgcttatcttgacaatccaccaacctcgatcggacctgttcaaacactttggcaacgtactgctccttgcccgtggcggtgctccagcatatgcaggtcccgccaaggagatgctcaactatttcggtaggcaggggtatcaatgcccacagcattcaaatcccgccgactttgccctggatatgataactgtcgatctgcagcgagacgacagagaggcagagagcagagagagagttgagaaactcatagaggagtggagaagatattcttcaggaggagacagggagcaggtgtggaagagggaggatgtgacgaggctcccagagataaccgaaaccgatgaattggacgaaaagaagccaaccaacggagaagtggacgataaagcagccgacaaggacgagacgtcgccaaagattcaacctgctgcctctcgcagacctttcaacaaggccaacctctcaacgcccgcagaactcggtgcacttgtccacagcccagcctccattgccactgccgtgcctttgcttctgcatcgtgccatcatcaacacgcgccggcagccgcagctcatcatggctcgcacgatgcaagtcgttgggctggccatcatcttcgccctcttctttgcgccactgcaccacgactactactcggtccagaactggatgggtttcatccaggaaatcggcgccttttacttcgtcggcatgctgcagaacgtcgcaatctatccgagcgagcgagacgtcttctatcgagaagatgacgacggagtgtatagcgtcgatgcgttcttgctctcgtacacgatcctcgaggtcccctttgagatactcagctgcctgctcttcggtatcttgatgtgtatcgccgtcggccttcctaggacggcaacaatgtactttgtctccgtctttggctgcttcggcatcgtctcgtgcggcgagagtctgggcatcatgtttaacacactcgtcaaccacaccggattcgccgtcaacatcatgggcatgtttctctcgattgccaacgccatggccggtgtcttgtccatagacgcccccgaggccttcaaggcgctcaattatctctcacccatccgatatgccttgcgctcaatcgccccttatgccttgcgagacgagcagttctactgcaagccgggacagcagcttgccaatggcacctgtccgatcgagacgggcaagcaggttcttcagctgtacagatttgaggacgacccggtggtgaacgtagcagctctggcagggtgcttggtggtatatcggctgctggcctggctcttgttgaggctggccagggcaagatggagtgggcataagaagtag

SEQ ID NO: 149 - protein, 1336 aa, Trichoderma reesei QM6a
MTDTSLDVPVTRNKLDRNRFSITGAANLSLDDVEAVHVQLRGLSISVDTSPSWLDPSTYPELFSAGFNSKPRIKTLLHSVDADLKPGTLTAIIGGSGSGKTTLLNNLAERVVSSRLSQQGLATFNEKVGVNSVRHAYVMQQDILLPTLTVRETLRYSADLRLPPSTSAEDRERIVEEVILELGLKECANTRIGNSQHRGCSGGEKRRVSIGVQLLANPSVLFLDEPTTGLDATSAYQLVRTLKALAQKGRTVITTIHQPRSEIWDLFDNLIILSRGSPVFSGPASDCLPWFQHLGHELPPFVNPAEFVIDVAAVDNRTPELEAETSARLESLKAAWKVESESRFPPLEAAAEVRTRQKHPQAATHAGFFRQVRILTDRTFKVTYRDPLGMTASLLEAVIMGVVIGYLFFDLGRDQAGIRSREGLLYTATGLQGYLILMFETYRLTIDMPTFDRESSEHCVDAVPYILSRRLARLITEDFPVPFLFSLILYFMAGFDHDASKFFIFFSIGFVNHFACIMCAFTCVVAVRHFPGASLIANFAFTLQSIACGIFIQVDTIPVYVRWLKWVTWSFYTFGAYCGNEFQGSFYDCPEPGGPSNPACLQYTGDYILSSLGFPKNWVARPIVCLASFVIFFFILSAVGLQYIKVEMTIARARVSDTDLSAGKEKMTARSIAEVRTIDVELENFSLDLDKRKVNGKKLPRKTIVQPINVNFQAGTLNIIMGPSGSGKTSLLNSMALRLRNSIGTHYRPSGKMSFNGAVPSASVVRSVCSYVCQDDDALLPSLTVRETLQFSAALRLPSFMSKEEKSRRAEEILMKMGLKDCADNLIGNDLVKGISGGEKRRVSIAVQVLTDPRILLLDEPTSGLDAFTASSIMEVLQGLANEGRTLILTIHQPRSDLFKHFGNVLLLARGGAPAYAGPAKEMLNYFGRQGYQCPQHSNPADFALDMITVDLQRDDREAESRERVEKLIEEWRRYSSGGDREQVWKREDVTRLPEITETDELDEKKPTNGEVDDKAADKDETSPKIQPAASRRPFNKANLSTPAELGALVHSPASIATAVPLLLHRAIINTRRQPQLIMARTMQVVGLAIIFALFFAPLHHDYYSVQNWMGFIQEIGAFYFVGMLQNVAIYPSERDVFYREDDDGVYSVDAFLLSYTILEVPFEILSCLLFGILMCIAVGLPRTATMYFVSVFGCFGIVSCGESLGIMFNTLVNHTGFAVNIMGMFLSIANAMAGVLSIDAPEAFKALNYLSPIRYALRSIAPYALRDEQFYCKPGQQLANGTCPIETGKQVLQLYRFEDDPVVNVAALAGCLVVYRLLAWLLLRLARARWSGHKK

SEQ ID NO: 150 - DNA, 1007 bp, Trichoderma reesei QM6a
  CDS (1)..(53)
  CDS (203)..(1004)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR44478.1 (5924)
  ref <309>: DATABASE ENTRY DATE: 2006-10-18
atggcgcccctgatccctcgcttgcatctctttgaaattgatgaccagtcatggtaagaaggccctctcaacgatgacgctacgattcccaggtttaggttgaatgtagtcaatctcttcaagacaatacaatacaatacaatacagtctcaaagaatggtcgaagcaagaatgaactcaaactaacagcagagagccacaggttccctacattcctgcgccgccgcatccaagacggtctcacccttgcatggaactccaacacgcctctccagcctcaatcgcccgcccacatcgccgcatccacgctcatagctgaactaggcagttctctatcttcttatacgttcatcgatttctgcgccggcgcgggaggacctacacctgccatccagcgagccgtcaacggccatctctacgctcagggcaagcggacagtcgactgtgtcttgactgatttgcaccccaatctcgacgcgtgggaggacattttcaggaacaatccgcagatcacgtttgagaggcagtccgtggatgcgagcaatgccccgagacgccttgtacagcgcaaggacggcaaaaaagtgatgcgactgtttaacctgtctttccatcactttgatgatgccctggcgaaagatatcctcaaggacacggtcaacacgagccatgaattcgccatctttgaactacaggatcgtagcctcgcaaatgtaatcacggtcctgatgctgggagttgcggccattgccatggcgcccctgctggcctggaagtggaggagtcccgccacgtttgtgttttcttggatcataccggtgcttccctttgtgcttgtattcgacgggctggtgtcttgtctgcggacgcggacgccgggagaagtagaggctttgctgcgtggctgcggtgcggacacgagcttgtgggagatgcgaagcggaagaagcaagttcatctggccctgcggatatctgcattgggtcgtctgtagacccgttgaatga

SEQ ID NO: 151 - protein, 285 aa, Trichoderma reesei QM6a
MAPLIPRLHLFEIDDQSWFPTFLRRRIQDGLTLAWNSNTPLQPQSPAHIAASTLIAELGSSLSSYTFIDFCAGAGGPTPAIQRAVNGHLYAQGKRTVDCVLTDLHPNLDAWEDIFRNNPQITFERQSVDASNAPRRLVQRKDGKKVMRLFNLSFHHFDDALAKDILKDTVNTSHEFAIFELQDRSLANVITVLMLGVAAIAMAPLLAWKWRSPATFVFSWIIPVLPFVLVFDGLVSCLRTRTPGEVEALLRGCGADTSLWEMRSGRSKFIWPCGYLHWVVCRPVE

SEQ ID NO: 152 - DNA, 4891 bp, Trichoderma reesei QM6a
  CDS (1)..(656)
  CDS (724)..(4888)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR44492.1 (124104)
  ref <309>: DATABASE ENTRY DATE: 2006-10-18
atgagtcatttgctgtggaaatacttctgggaaaacgatgtcgacaagtttcggcgtctgctggccccggccggccccaattcccaggcggcggcggtgaggagtccagccgtgggcgctgcgtcgcatcttggagcgagtcccggtagtgtcgggacatcgccgagagctaccgtcaagtcgcgcaagccgtcgggctatgctcccggtcttgggaaggcaagagacggaagttctgggttgagcaaagcggaagtcaacagccgggaccatgccggcctgacgctgctgttgcgcgcatcctcatcgaccgatccaaacgctctggcctttgtccaggctctgctggatcacccccaaatcgacttatacgcccaggaccccgagagtggctggaacgccctccacaggtcgctgtacgctggaaatgcatcaatagctcgagcattgctggccaaggagcgtgacgatttggtcaaccacgcccttggggccgtgaacaaggtcggccagctgatcaagaccaaggatcacgagggcaacagcccgtttgacctgtataactcgacaattgctgcgagatcgttgcgccatacgctggtccaatctctaaacgatgatgattcggactatggcgacggcgactttgagcaaatgttcgtaacggccttccaagtctcattattttgtatccgcttctaacgctgaccttgacccatttagctcgacgaaactctcccatgccaacaagcattacgccgagggagacgagttgttcatgtttggcagcaacaaaaacctgtccctcggagttggggacgaagacgaccggcaatatcccgagcgcatcatgcttcagcggtcagatcagctgatacgccgattcttcgaagattatctgacgcagaaacatgtcgatgcgccactaaacgtcacgacagatctggaggccatccccactcttgttcaaaatcgatccctagtcatccaggacgtggccatgtcgaagctgcatagcgcgattcttaccgacgatccgatatccaacctttacgtctgtggagttggtcgcggcggaaggctaggccttggcgacgagaacacacagttcaagtttactcctctccatggtccctttgcggacaaaaaggtcagccaggtggcactggggcaaaaccactcaatggccgtcgtagggaacggtgaactgtggacttggggtctcaattccgactcgcaactcggctacgtgctgcctcctcctctgaggacggatgaggagccaatgagcctcgtcccacgccaagtattcggtcctctcaagaaagaggttgtcctcggcgtcgccgcttcgtccatccactcggtggcgcacacaggctcgtcactgtatacctggggccgtaatgtaggccagcttgccctgatggattccgactctagatctcttgacctgcagcagactcctcgaaaggttgctgcgtctctactatcggccccgatcgagatggtctcggcgattgacagggccactatttgcttgttatcgaatcaccaagtctgggtgttcacaaactatggttacaacctgatacgatttccctttcccgatgcggctctccaccggaggcttaacgcaagcctctattcggccatgtccgaagtgtcgcggagggacattcggtacatcacatctggaggcgacaccatcgcggcagtcacagctcgtggcgatttgttcaccatgcaagtgagcaacaagggtgatttaggagccccttccggctctacgaccaaccctgttaagatcaagagtgccgtgacgcagccgcagtgcatatgggactcaggaaaagacggcgttctctcagttggcgttggggaacatggatctgtcatcatttgcacagaatcgggcgctgtctggaggagaatcaagcgcctcaagggcaagtttgagtcttctgtggatgcaaggaggaaagatttcaagttccagcgcgttccctacatcaccgattgtgtggctgtccgcagctctacttttggtgcgttcgccgccatccgaaaagattgcaaagtcatgtctcaggaaattcccattgccgagcagggcctctggaaggacattggcgcgcttctttgcctgaaagatttccatgctcctggcaccgacgatgagagagattcgtcacgaaaagcctggaacgcttccattaggagagagggtcctggcactgtggcacaccagctcctaagctccgcagacatcgaaacggacttgctccgctggctacaaggcaactactccttgtacgacaccgaccttgagatccgcacttctgcggccccagacatcaggataccggtccacgggtggcttctctccgcaagaagctccatcctccgcgcggctttgtctgacttccggctggatggctctcaagcccaatcggagacctttgtcatcgaatgcctcgacgacaagatggtgctgaccctgctccatgttgatatctttacaatgctcaacgttgtggtatatgcctacctggacaacatcgtccccgtttggaagtacacccgtgaagccccggcgatggcccatcgcttccgtcaagttcggacggatctgatgaaggtcgctacaaagctcaatatgcccaagctggaagccgctgcccggttacaggcagggttggaacgaacgctcgatgctgatatgcagggagccatcaacgatccgatgttcttcgatgacggtgacgtcgtgttggagttggatggcgacgaggtgacggtccacagccatcttctctgccaacgctgtccctttttcgacggcatgttcaatggcaggtcgcaaggccagtggctgactgaacgtcgtcatggagcacagcaggcagaaccggttcggatcgacctcaaacacatccacccagaaactctttcttatgtgctcaagtacttgtacggagacgttggcgaggaaatcttcgatgatgtgacggctgcgtctcttgatgagttctcggagctcgtcttggatgtgctcagcgtggccaacgagctcatgatcgaccgattgtcgcagatatgccagtccttgattggcaaattcgtgacaacgcgcaacatttccaatctcctcaacgtaatcagcgcctgtgcagttgcggagtttaaggatactggtctggagtacttgtgcctgcagcttgaatccatgctcgagaatcacctcttggatggcctcgacgaagagctcctgtatgagctagattgcaagattcgggacaatcagctcgcgtgcttcccatttgcaaagagcggcagagcggagctactgctccacgagaagcatcctgacctggcggcggatattgaagaagaaaggcggcgccgcgtcaaggagatggcatttagacatgcacagagggaagaggagaagaggttgaatactgcgtacaaagcgcgctttggaagcttggatgaccctacccgaggaccaccaactccggagaagaacagcaggcagcctcgactgggcagaaacgagccatcaagcccggctttaagggcaaaggactcccttaccgacatgatctttgacatggaggaggtagggcactcgggaggaagcagtgttgtatctccacaattgtcaccaccacttacccgcgttcatgtcgatgatgtggcgacgtcaaaggccccggcggaatggaagaagtcaaagggcaaagaaaaagcagagatacctcagtcacccgctgcaagtggcatttctcgccagcagccgacgatggaccctgtgatactcaggagtgaagcagggtccccttactcggcaaacaactccccatgggctcctgcggcgctgtctaccgctaagctagatttgaaggacatcatgtctgaggcttccgggaagtcggcattgtcagccgctctatcagcagcccagacgacaaaggaatcggccagcaagccgcagccgctgtccaagatgtcacaaaaggaacgcaagagacagatgcagatgcagctcgaaacccaagtcgcagcacaggaggagcaggcaagggcggttccgtgggaaacagcatcatccaacaagaagcagcagccgccgccgtggaaagctgcagctcccgttccaaaaacttcactgcagcaagccatggcatctgacgttgcgcagcggaatgcgatttctaccaatgccaaacccttggtggcgtctgaatctaacgttcagtccgcacaaatacggacagcatctccagacactcgcttcccaggccaagggcggcctggaaactccccagcagcgacgccgcaagcaggctctggaggaggattggggaagcagccgcctagcaagcctctgataccgcactcgaaatcttacatcaagccggcgcagaagacggaaccgacgttggggctgagcatggcggatatcatcggacagcagcagagagaacagcagctggtcaaggaggcggtggcaaagcgatcacttcaagagattcaacaagagcaagctttccaagagtggtgggaccaagagagccgtcgtgcacaggaagaggaggccaggcgacaaaatagagcaaagggcaaggaagagcagcaggggggaggaggcggaggaggaggaggaggaagaggtggtggtagtggtagtggtggtggtggtgcaggaggagggagacgtggccgtcggggcagaggcggaaaggcccgaggcaatgagccgtcgagcaatcagcagcagtcgggcgttgctgaaggcacgagttccagggaagcacccaagactggtggtaatgcgtcccggggtggcagaggcagagggaaggccggcagaggcggggcatag

SEQ ID NO: 153 - protein, 1607 aa, Trichoderma reesei QM6a
MSHLLWKYFWENDVDKFRRLLAPAGPNSQAAAVRSPAVGAASHLGASPGSVGTSPRATVKSRKPSGYAPGLGKARDGSSGLSKAEVNSRDHAGLTLLLRASSSTDPNALAFVQALLDHPQIDLYAQDPESGWNALHRSLYAGNASIARALLAKERDDLVNHALGAVNKVGQLIKTKDHEGNSPFDLYNSTIAARSLRHTLVQSLNDDDSDYGDGDFEQISTKLSHANKHYAEGDELFMFGSNKNLSLGVGDEDDRQYPERIMLQRSDQLIRRFFEDYLTQKHVDAPLNVTTDLEAIPTLVQNRSLVIQDVAMSKLHSAILTDDPISNLYVCGVGRGGRLGLGDENTQFKFTPLHGPFADKKVSQVALGQNHSMAVVGNGELWTWGLNSDSQLGYVLPPPLRTDEEPMSLVPRQVFGPLKKEVVLGVAASSIHSVAHTGSSLYTWGRNVGQLALMDSDSRSLDLQQTPRKVAASLLSAPIEMVSAIDRATICLLSNHQVWVFTNYGYNLIRFPFPDAALHRRLNASLYSAMSEVSRRDIRYITSGGDTIAAVTARGDLFTMQVSNKGDLGAPSGSTTNPVKIKSAVTQPQCIWDSGKDGVLSVGVGEHGSVIICTESGAVWRRIKRLKGKFESSVDARRKDFKFQRVPYITDCVAVRSSTFGAFAAIRKDCKVMSQEIPIAEQGLWKDIGALLCLKDFHAPGTDDERDSSRKAWNASIRREGPGTVAHQLLSSADIETDLLRWLQGNYSLYDTDLEIRTSAAPDIRIPVHGWLLSARSSILRAALSDFRLDGSQAQSETFVIECLDDKMVLTLLHVDIFTMLNVVVYAYLDNIVPVWKYTREAPAMAHRFRQVRTDLMKVATKLNMPKLEAAARLQAGLERTLDADMQGAINDPMFFDDGDVVLELDGDEVTVHSHLLCQRCPFFDGMFNGRSQGQWLTERRHGAQQAEPVRIDLKHIHPETLSYVLKYLYGDVGEEIFDDVTAASLDEFSELVLDVLSVANELMIDRLSQICQSLIGKFVTTRNISNLLNVISACAVAEFKDTGLEYLCLQLESMLENHLLDGLDEELLYELDCKIRDNQLACFPFAKSGRAELLLHEKHPDLAADIEEERRRRVKEMAFRHAQREEEKRLNTAYKARFGSLDDPTRGPPTPEKNSRQPRLGRNEPSSPALRAKDSLTDMIFDMEEVGHSGGSSVVSPQLSPPLTRVHVDDVATSKAPAEWKKSKGKEKAEIPQSPAASGISRQQPTMDPVILRSEAGSPYSANNSPWAPAALSTAKLDLKDIMSEASGKSALSAALSAAQTTKESASKPQPLSKMSQKERKRQMQMQLETQVAAQEEQARAVPWETASSNKKQQPPPWKAAAPVPKTSLQQAMASDVAQRNAISTNAKPLVASESNVQSAQIRTASPDTRFPGQGRPGNSPAATPQAGSGGGLGKQPPSKPLIPHSKSYIKPAQKTEPTLGLSMADIIGQQQREQQLVKEAVAKRSLQEIQQEQAFQEWWDQESRRAQEEEARRQNRAKGKEEQQGGGGGGGGGGRGGGSGSGGGGAGGGRRGRRGRGGKARGNEPSSNQQQSGVAEGTSSREAPKTGGNASRGGRGRGKAGRGGA

SEQ ID NO: 154 - DNA, 2388 bp, Trichoderma reesei QM6a
  CDS (1)..(43)
  CDS (154)..(314)
  CDS (437)..(1207)
  CDS (1267)..(1339)
  CDS (1396)..(1602)
  CDS (1679)..(2385)
  ref <301>: AUTHORS: Martinez D. et al
  ref <302>: TITLE: Genome Sequence Analysis of the Cellulolytic Fungus Trichoderma reesei (syn. Hypocrea jecorina) reveals a Surprisingly Limited Inventory of Carbohydrate Active Enzymes
  ref <303>: JOURNAL: Nature Biotechnology
  ref <304>: VOLUME: 26
  ref <305>: ISSUE: 5
  ref <306>: PAGES: 553-560
  ref <307>: DATE: 2008
  ref <308>: DATABASE ACCESSION NUMBER: EGR44490.1 (70251)
  ref <309>: DATABASE ENTRY DATE: 2006-10-18
atgttccgagcggcggcggctgggccgtttgacgaggtcgtcagtaagtttctcagcctcgccgccaaagggagacgccttttagcatcggaagagcttccatctgcgtcttcatttccccctgttccgctttcgctaacggcatcctcgcagccaaggcgactgacgagaacctgacgtcggaggactggggcgccatcatcgaggtatgcgacaaggtgtctggcgaccccaacggttccaaggaagccgtccagagcatgatcaagcgactcgcccatcgcaacgccaatgtccagctctacaccctcgaggtttgtccatctgtccatctgttgtccccccatcccttctgatctcccccgctcgcagcagcgccgaggccgaagaggcaattgaagaacacgcaaactaaattcctctgtcttccaaccagcttgcgcacgccctctgccagaactgcggcaagcagatgcaccgcgaaatcgccagccgtgccttcaccgaggccctgctgaagctggcaaacgaccgcaacacccaccagcaggtcaagagcaagattctcgagaagatgcatgagtggaccgacatgttcagcagcgacgccgacctgggcatcatgagcgacgccttccacaggctgaagcagagcaacccctcgctgcagccgcccagcgcgcctcggaaacagggcctgaccgaccaagaccgccagaaggaggacgacgagctgcagatggctctccggctcagcttgcaggatgaggaacgcaagaagccggcccaggccacgcccgcctcacaggcctcatccagcagtcagcaacagcagcagcagcagcagactactcctgggtctacagcggtgccttccggtacaacggctgccacggtcagcagggttcgcgccctcttcgactttgtgcccaccgagcccggcgagctggagttcaagaagggagatgtcattgctgtgttggagagcgtgtacaaggactggtggcgcggctcacttaggggaaagacgggtatcttccctctgaattacgtcgagaagctggcggatcctacgcccgaggagatgcaacgggaggctcagatggaggcggaggtctttgccgagatcaagaacgtggagaagctgcttacgctgctgagcgcctcgaacacggggccgcgagaggaagacaatgaggagatatcggtacgcattgcactcgcctcgcaaccaaggccgttgtttggctaacatggttcatgcagaaactatatcatcagacgcttgccatccgtccaaagctgatcaaactgattgaaaagtactcgcagaagaagggttcgcaatgtcctgttccttgcgtgtcgttgagcacggactaacaatcaacgcagatgacttcacccaactgaatgagaaattcatcaaggcgcgaagagactatgaggcgcttctggaatcgtccatgtctcaccctcctcagcacaactaccagcagtatgctatgcggcctgctcaggcgtatcctcccccaggaggcaactacccgccccagccccagccgcaggatccccagagattctacactcctgggccccaaggttcgattccacgcacgctctcgcactgatcaaatcgatccttctgtcagctcgagtcgctaaccgttggcataaggccgtccacagtttcaacagacttcttccccgccacctaactttccgcagtctggcgttcccccacaggcgtcttcccacccagcgcccttttacgtagcagggaccgaggtgccaactcatgctgctgctggccagccgcctgctcctcaacagcagcagtatcctccgagtgaccacggtcctagaatacccgccaatggcaaccagcctcctcctctcaacacttcagcatcgccgtcccagaacttcaatcctttcaaacagcctccgaaccaagggccaccaagcacccatggcgcccaggaactagccacgtctgtctacgactctcccattgctcccaacaacccgacctctgccgctacgtactccagctccgtctattctcaagaaggccctgggataccccatcccaaggacaatgagccaatagctccatacaccactcaacaaccagcatatcaaagctatcagcctcctcagcaaaactcctctgctccccccaaccaggcgtcacaacgccctcccaacgtcatgagcccgccgcctctgcagcccagcggcgctgcgtacgacgcccgccaggggctacccagtcagtcaggccctggttcagggcagcagtacaggccgtatgtgccccccggctcgtcggaacctagtgctccggctccaaacgactactatcgccaatccggcgtctactaa

SEQ ID NO: 155 - protein, 654 aa, Trichoderma reesei QM6a
MFRAAAAGPFDEVVTKATDENLTSEDWGAIIEVCDKVSGDPNGSKEAVQSMIKRLAHRNANVQLYTLELAHALCQNCGKQMHREIASRAFTEALLKLANDRNTHQQVKSKILEKMHEWTDMFSSDADLGIMSDAFHRLKQSNPSLQPPSAPRKQGLTDQDRQKEDDELQMALRLSLQDEERKKPAQATPASQASSSSQQQQQQQQTTPGSTAVPSGTTAATVSRVRALFDFVPTEPGELEFKKGDVIAVLESVYKDWWRGSLRGKTGIFPLNYVEKLADPTPEEMQREAQMEAEVFAEIKNVEKLLTLLSASNTGPREEDNEEISKLYHQTLAIRPKLIKLIEKYSQKKDDFTQLNEKFIKARRDYEALLESSMSHPPQHNYQQYAMRPAQAYPPPGGNYPPQPQPQDPQRFYTPGPQGRPQFQQTSSPPPNFPQSGVPPQASSHPAPFYVAGTEVPTHAAAGQPPAPQQQQYPPSDHGPRIPANGNQPPPLNTSASPSQNFNPFKQPPNQGPPSTHGAQELATSVYDSPIAPNNPTSAATYSSSVYSQEGPGIPHPKDNEPIAPYTTQQPAYQSYQPPQQNSSAPPNQASQRPPNVMSPPPLQPSGAAYDARQGLPSQSGPGSGQQYRPYVPPGSSEPSAPAPNDYYRQSGVY

SEQ ID NO: 156 - DNA, 36 bp, Artificial sequence
  GenFW
cctcttaacctctagacggctttgatttccttcagg

SEQ ID NO: 157 - DNA, 44 bp, Artificial sequence
  GenRV
tgattacgccaagcttggattacctctaaacaagtgtacctgtg

SEQ ID NO: 158 - DNA, 33 bp, Artificial sequence
  Trire2_59740 infusion fw
gacggccagtgaattcgcgtgatgcgaacaaag

SEQ ID NO: 159 - DNA, 37 bp, Artificial sequence
  Trire2_59740 infusion rv
atcaaagccgtctagacaagtctgggaatctcaatgg

SEQ ID NO: 160 - DNA, 18 bp, Artificial sequence
  Trire2_ID59740 fw
tgcgtgatgcgaacaaag

SEQ ID NO: 161 - DNA, 18 bp, Artificial sequence
  in_geneticin rv
atcccgaaagcatcaccg

SEQ ID NO: 162 - DNA, 7905 bp, Artificial sequence
  vector pFSG_ID59740
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattctgcgtgatgcgaacaaaggagcctgctcttttgctattttacttgacggacgccccctccccggtcgccgcccgccgatagacccactgtcatctggctgagcgggcatcccgtccgacaagctgctgccacgccgcatctgaatggcctctctgcctgtccagggatttgcgccccttcttgtacaaaaccaggactcatccgcccccccccccctctctctctatcatttcgatttactcattccattgtcttccaagacaaggacaagaaggtgctgcctcgtttgactgatgctcaatcttgccgtttgatgaacgggtagtttggacttgttaccttgcctgaagtcattcacaacaggtgacagttgctgctccgggcctctttgtcttgaacctagtcttgccttctttcctccatttggagcttgaagccctgagacgacacccttcctttgctctccttgactctccgccctgcgcctctttgcaacgtactatcagagtccctgcttgcctgatcgatctctgcttccccgggtctccgctctctctctgcctccgccttctgccaagtcccgaagaagccataactcaccatgtcacacgcgccgggatccgagccccacaagcggaaacggagtattgaggatgacggccgccagcttgcgtatcatcgccagggccagccctcgtcaggcctctcttcatgtatgtctattcctcctcttgaagcgatagcctctcacacattccttttgattcctcatgctccctcatgcccgccgaccactgcaaagctcgctcgccacatcggcttgcgtgcccccaacccccgtctccttttcactgtgtcatctatcgtgcatcgtgctccacgcagaagaatgaatcaatgttaatcaagcccagcggctcccgaatccatcatcaaattcacgccaagaaacaactcccagcttttagccttgctgccaggcgatgcagataccttcagcgacatcgtctacctcattagtgaatatgaaggtatgcttccatctgcgcgccttgttccttacccggtcacggcatacccatgcccatgcccatgccctgaatatgcgttgtaaagaatgtgctgacagggtgcactctgcgtgcaggcgtcatggaccgcagcgaaagccttgcggccaatcttggggccaagctgacaggtccccgattcctacgcggcctcgaaaggttcttcgagggcccaatcagcatcaattcgcccaatccagacgcccagcaagtcacctggttggacgtggtcatgttggcgaaagcgagcccggatgcatttgctctcgtctccttgcccagcggtgcacgttgctgccaattcatttaccaggggttgcaggtcgagatcaccgaggatgactggcgcctgatctcttccggagcactggacaggttcccactggagcacacgttcgaagaggacgaggcggccgagctggcgacactcgagattctccaacagcgggccttgctgctgcataggagggcagacgaagttgcggagagggctcagatcctgcgtcagagactcgagcttcgcagacatgtcatttctcggcggcaacaactccataatggcacctccagctccagctccagctccggctccagctccagctccggctccagctccagctctagtcctagcttccatgccatcaatcacctaccgcgttccgccatcagctcgcacttcgacctccatgcagaccttctccagcagtttaccacggctgcaatgcaaaacagcccaccgtcaggggcgcctccggaataccaaccacggcccacgtcggtgtctagccagggttcgctggcaccgccgagcttggaagcaccgccgtatcagccgccctcggccgcggaaccacccttggccccggcaccagcccccatgtcaacgtcggctgcgagtccatcatccacagcgccagctttgacgccgacgtccaactcgcggtccattgcgacaatggccatacgccaggcggcgcttcccggcgacccggccacggaagtatacaggccccttgtactgcagaagacggacacgctcaacaagggcgacgttatattcccaccctgcgaccgatgccggcgtctccgcctgcagtgcattaagcatctgacggcgtgtcggggctgcaccaagaaacacgcgagatgcaactggaggaacatcactgacgacgaagccgcggctataaaggaggatctggaaaagatacgccgcgaggcacagaaggcggcggcagcggcagcggcagcacggcagcagtccaatgccggcggcaatcctcggccttatgaggcgggccccagcgcgccggcaagctacggcgcaggaaccatggggccaacgccgtcactgcttgctccgcttgcttccctcgctcctctagctcctctagctcccctggctcctttgactcctttggctcctttggctcctctgactcctctggctcctctggctgctctggcgccggccgctgctcccgagccgcctcgaagactgctgcccacggcccgactcaccgggatcgagccaacgcccaccacgcctcgaagccctccgcggcgaacggggcagctcgcctccatcttgtcgcctcctgactatgagccgcagccgtttgggatgttgccggatctggccccaagatgaagctggtggcgatgcatgaaggcagcgtgtatacgagggaaaatttgttatggttttttgacgattgggaatagtttgctacattcatgagctgctgggatatggaggaaggggtcaggatggaattctgggattagggtgggatatcgtacatatggtgggattggctgagccattgagattcccagacttgtctagacggctttgatttccttcaggtcatacgaggcttgtgcaatggtctccgcatggatcgctgctgttctcctatcaaactcggattttgtcttaggggatggcgtaggaaagacgctgccgcggttcagaagcacctcgatgctatcaggatgtgacaaaaacgactcgaaaacccggattcatcggtgatgctttcgggatcgcaagcgtaaagaaagactctcttccaagacctagaagtatagcaaaatcagcagcagaccatcaatgtatagcgaatgcgcccatacaaaagctgaacgtccccggagaagcacttgtccagggacgggaaataggcttccggaacgggagccattggcagcacagctatatcattctaagtaaacaaatgtaatgagcaagcggacggagtgctgaaacctccgtatgcctgaagccgacgaaagcgcgttggattagaggtcgacagaagatgatattgaaggagcactttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtgaacgacccggtcataccttcttaagttcgcccttcctccctttatttcagattcaatctgacttacctattctacccaagcatcgatatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatggttgcctagtgaatgctccgtaacacccaatacgccggccgaaacttttttacaactctcctatgagtcgtttacccagaatgcacaggtacacttgtttagaggtaatccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 163 - DNA, 1302 bp, Hypocrea jecorina
  CDS (1)..(980)
  CDS (1038)..(1302)
atgccagctttgccgcctcctgtgcttgtgtcgtgccaaagtaaatcacgagcccaaagacttcatggaatattacctcgacaaggcttctcacgtactacgggcctcactgaatggcgccgcattaatctccatatactcagatccaggtgtttaatacatttatccttcactttgcggctgggcagatggctgacgtttgatgtcctagcatgcaagtacgtgccgtcatacgcacaagtcggattgccaattctgcccgagctcgggagcccaaagcaatttgagctcttgcatgagtgggtgagacgatgtgaccggacgcatacatgtcttccgcaccaggatggtagtaacctggctggaaagatgcctacaagagtcatagaagttggagaccatcatatgcgcctcgtcgaaaccaggaatggcatcaagggaaagtatatcgccttgagtcactgctggggaaatctcacaaaagaggagagattttgcacatatgcccacaacattgacgtattgaagagaactattcccttcaattctctaccggcatcattccaggacgcagtccgagtcacacgtgccctgggcgttccatacctctggattgactccctttgtgtcattcaggaggacgaagaagactggaaatctgaagctaccaagatggaagacgtcttcagctctgcatatttaacgatcgctgccagctctgccgcctcttctctggacgggtttctcggtaacagaacaccgagagtttgggctgacatcccgaccactcgaggacgattgtaccttgcggaggcaattgacgattttgatagggatgtcgaacagagtgtactcaatacacggggatgggtactgcaagagcgagcgctctcgcgtcgcacgatattcttcacgtcaacccaactctattgggaatgtggccagggcatcgtctgcgagactctcgcgagattgagcaagtaaggatcacgaatcacatgtaacgacggactactgacatgatttggaaaactcagtcctcaaacacagcacttgggcgaccctaactttcctcactcttcccccatcacctacaaggaccaacgtgtacgacttatccaacacatatatcaattgttcagcaagcttcaactcacggatgcgacagaccgtccaaaagccatatcaggactacagagtcgactcgctaacacgttccaatttcgagccgattatggtgttcattggcaatacccagagagaactctgttgtggcaatctgagatccctggtagcctatct

SEQ ID NO: 164 - protein, 415 aa, Hypocrea jecorina
MPALPPPVLVSCQSKSRAQRLHGILPRQGFSRTTGLTEWRRINLHILRSRCLIHLSFTLRLGRWLTFDVLACKYVPSYAQVGLPILPELGSPKQFELLHEWVRRCDRTHTCLPHQDGSNLAGKMPTRVIEVGDHHMRLVETRNGIKGKYIALSHCWGNLTKEERFCTYAHNIDVLKRTIPFNSLPASFQDAVRVTRALGVPYLWIDSLCVIQEDEEDWKSEATKMEDVFSSAYLTIAASSAASSLDGFLGNRTPRVWADIPTTRGRLYLAEAIDDFDRDVEQSVLNTRGWVLQERALSRRTIFFTSTQLYWECGQGIVCETLARLSNPQTQHLGDPNFPHSSPITYKDQRVRLIQHIYQLFSKLQLTDATDRPKAISGLQSRLANTFQFRADYGVHWQYPERTLLWQSEIPGSLS

SEQ ID NO: 165 - DNA, 1546 bp, Hypocrea jecorina
  CDS (1)..(501)
  CDS (557)..(1543)
gacaaggccgagtcgcttgttcaaaaggacaaagtcatttccacgttgcgtgcaaaccttgccgcagcgtctcagtccagtatccaacaattggcagactatgttatgaaggcggcaaagaaagtctttctgactctggtcttcactgacactatcaagcacatcgacaaactccagcgtgatggcttcggcgacaacgatctaccagtgtattccaattcgagccccaataactcgaatatacacgaagttcgcagcctggagtcaaatgctctccagaacggcttcgcagactggagtctacgagaggtcgacagcttctgccagcagcagtgggtttttctagctccggtttttcaagaagacaaattcgtctacacattgtacaagggccagccacttcctttcataccagcggaaaagcctagagggtattcggggcgtttcgggacggtacaaaagcttcggctatatcctacacactaccagcgagcatcgactgtaagtcttttgcgtggaaagcccagaaggacctccgctgacatgcatactctagcccaaaaaaggagccgatgacaagattggcagagcttttgatgtagccctgaagcgattgggccctcaaaacccagagacagagagattctacaaaaaagagatggacacgttgagcgtgatgagaggtctggacaacaggcatctcatcaaggctattgcgacattttccttgggtagtgagagatactttctgttcccatgggccgacggaggtaacctacaggagatgctcaaaaatgacgaaagaggccttgatagggagctggtgagctgggctctcagtcaagctcttgggctttccagtggcatcagccagcttaatggcctaaagattcgccatggagatatcaagccatccaacattgtctgttttggcagccctactgggcccactcttgtgatcacagacgtcggccttgcgaaacatcacaaggaggatacccgcgaccggatcaactcaacaactacaaggcacggcagtatggcgtatgagcccccagaggtgactccaaaatctggaaaggtcattctctcgacaaaacgttacgatgtctggtctcttggctgcgtctgcttggagctcatcatttggctggtctacggaagagcaagtctcggtttattccacaaggcactcaacagagacccgactaactgcaagttctggatggatcacgcagtctggggtcgcaaaaagcacgttgtggtcaagaagtggcttaagaagttaaagggagatctcaaagaagcatcagcactccatgacgtggtcaagctgatagagaagaagttattggttttggccgatgatcgagcggattccaagtcattgtacaacacgctggagagcattgccaaaaaagcgtcgcagagtcctcaatacctcttcgacgcaggcattgaaaagctagcatcgaaaaggaagacgctcatgcttggcgatcctgctgatgaagacctgttgatctcactgtcttcttcattttga

SEQ ID NO: 166 - protein, 496 aa, Hypocrea jecorina
DKAESLVQKDKVISTLRANLAAASQSSIQQLADYVMKAAKKVFLTLVFTDTIKHIDKLQRDGFGDNDLPVYSNSSPNNSNIHEVRSLESNALQNGFADWSLREVDSFCQQQWVFLAPVFQEDKFVYTLYKGQPLPFIPAEKPRGYSGRFGTVQKLRLYPTHYQRASTPKKGADDKIGRAFDVALKRLGPQNPETERFYKKEMDTLSVMRGLDNRHLIKAIATFSLGSERYFLFPWADGGNLQEMLKNDERGLDRELVSWALSQALGLSSGISQLNGLKIRHGDIKPSNIVCFGSPTGPTLVITDVGLAKHHKEDTRDRINSTTTRHGSMAYEPPEVTPKSGKVILSTKRYDVWSLGCVCLELIIWLVYGRASLGLFHKALNRDPTNCKFWMDHAVWGRKKHVVVKKWLKKLKGDLKEASALHDVVKLIEKKLLVLADDRADSKSLYNTLESIAKKASQSPQYLFDAGIEKLASKRKTLMLGDPADEDLLISLSSSF

SEQ ID NO: 167 - DNA, 1289 bp, Hypocrea jecorina
aaactttgatctgggaaatcattacattgggataaactgccaaattccggggaccccctaaagattttgatactaagctatatatgaaaatatataagtggctgaactaatcactcaggtatagtaacaagtcaaaatatgattgaaaatgaaatgggatatcgcggatctaagtcaatagtaagtcaaaatactattgtaaaagagcaacgggtagacggtagttacattgaatattttaataagaaaaaattatcaatgttaaggtatactctagtgggcttcgaaagaagttatctgaccaaaaacccttctaactttataaatttaaaaagaaattttagtacgttagaatctaaattaaatcctttttacgtcacaggttttgtagacggtgaaggttcttttatattaactataataagagataataaatataaatctggttgacgtgtagcttgtagatttgtaataagtttacataagaaagatataatgttattaaataacattaaagaatttttcggtacaggtagcgtattccatatgtctaaggactctgcacaatatcgtgttgaatctttagcaggtttagatattataatcaatcattttgataaataccctttaattacaaaaaaacaagcagattataagttatttaaattagctcataatttaataaaaaataaaagccatcttactaaagatggattattagaacttgtagctttaaaggctgtaataaataatggtattaataatgatttaagtattgctttcccaaatattgctactgtcttaagacctgaagtagaagaacctcaaataatgaatccttattgattatcagggtttgtagaagcagagggttgttttagtgttgttatttttaagaataaaacatctaaattaggtgaagcagttaaattaagttttatattaactcaaagtattagagatgagtctttaataaaaagtttaatagaatatttagggtgtggtaatacaagtttagattctagaggtactattgattttaaagtaactaatttttctagtataaaagatatcattattccttttttcattaaatatcctttaataggtaataaaaaattagacctatcagattttagtgaaataacaagattaatggaaaataaatcgcatttaaccttagaaggattaaataaaataaaagaaatccgtaataagatgaatacgaatagaaaataagtttaaaatcaatgtattaatttataaacacgagaaatttggtttaaacg

SEQ ID NO: 168 - DNA, 756 bp, Hypocrea jecorina
atgaataataataataataatttaacaattaaacctataataacttactgtaattgtgagcttgaaaaaagtcgtataattacagaaaataaaaataaagctgtcatttatcgttgagttaataatattaacaataaaacgtatataggaagctcgattaatttatctgtaagaatgtataaatattacagtattaaacatttaactaaatataaaactccaattcacaatgctcttttaaaatatggttttcaaaactttaatttagaaatacttgagtactgtgaagagggtgtaaatcctacaataagagaacaatactattttgaattgttaaacccagagtataacattttagaaaaagcaggctcttctttaggattcaaacatagtgatgaaactttagagttttttaaaaatgaacgtaaaatcagtgaagaaacaagaaataatttatctttagcggcgacaggcagaatatttactgaagaagataagaaaaaattatctgaaatacgtaaaggtattaaattatcagatgaaacaaaagctagaatatctgctgctgctactacccttagaggtgtaacagttatagttaaaaatataaacactaatgaagaattggagtttagaagtttaacagaagcaggtaaatatatagatgttagtagaacagctataagaaaatgtattgatacagggaaaccaatcaaaaataaatttatagtggccacaaaacttcaaaaaccatag

SEQ ID NO: 169 - DNA, 965 bp, Hypocrea jecorina
  CDS (1)..(963)
atgtttgacgaagtcaacctatacatacggaattaccaccatctccttgactacgccgcaaggtattggggaaaccatgcctgcggggtcccagagaggcaactgatgccggtcatctcggatttcttatgcaaccacgatatgacattaatcagaagattagcgttaccttcttttgtcggaaattcagccattcatgttgcagtttttttccaactcgaaaacacaatcctgcatctgatcgatacaggacatgatgttgatgtcgctgttgataccttcagctacagagtgacaccgctcatgctggccaccacaatgcagagtgaaagcattatcaagcttctgctcgaacacggtgctaacgctaacgtcatcatcccctacgcgtattccaaaaaggtcgaaccagatgaagccatatattcgcttctagccaagacgaaagccgccgatagttcaaacacattttctgttccgagagtgctcgcgttcgacttcttccggcgggtgagtggcttagatggggacacttcaaggatgtgtttactatcacaggcaattcgtttcgggcatgagagcattgtcaagctgctcctggagcatggcgccaatgttgaaggcaattctactctcaatgacacgactccactcgtctgggcaatgatgtgtccgacagagggcatggttaggctgctgctggagtatggcgccgatacgcgaccacttgtcaaatgcttgcggaaacagaaggagccaatattgttggtcacgacgctcgggaacgagggtatcttgagactgctgctggaaaacggcgttgctgctgatttggtgattctagggaagccgttgctggtatgggcatttcagatggggaaacaagctgcagccaacatattgcaggaatatggcgcccagctacctaacgattggcaacatcagtatcttttgaatagctggac

SEQ ID NO: 170 - protein, 321 aa, Hypocrea jecorina
MFDEVNLYIRNYHHLLDYAARYWGNHACGVPERQLMPVISDFLCNHDMTLIRRLALPSFVGNSAIHVAVFFQLENTILHLIDTGHDVDVAVDTFSYRVTPLMLATTMQSESIIKLLLEHGANANVIIPYAYSKKVEPDEAIYSLLAKTKAADSSNTFSVPRVLAFDFFRRVSGLDGDTSRMCLLSQAIRFGHESIVKLLLEHGANVEGNSTLNDTTPLVWAMMCPTEGMVRLLLEYGADTRPLVKCLRKQKEPILLVTTLGNEGILRLLLENGVAADLVILGKPLLVWAFQMGKQAAANILQEYGAQLPNDWQHQYLLNSW

SEQ ID NO: 171 - DNA, 1286 bp, Hypocrea jecorina
  CDS (1)..(329)
  CDS (378)..(678)
  CDS (731)..(1038)
  CDS (1064)..(1283)
atgagccagcgtactacattccgcgttcaaagagtgcctttggactggcgtgcgagtcgtctacgggcctgtctggaacaacatgacccttcctcaagcccagtcatacgatctttagcccttgaagtcgatcgtcgttcctatacggctaccgtggatttccgcagtcggccactggtgacgcagagcccgaagccgtgggacatttctttgggcgactttggagagaacgactcttccgacaacggctacatcacacttgacgatgatctgcttggcattactactctatatctgccgtccgatgaaaaccacaaagcagagtacgtgtagatgcaatccgacttcaccatgatctctcacacccaaatgaacagtatcattgccctaggcagcatcagtggatgccccctggactcttttgaagatgaggcaagcagtcatgtctggctcagggacgtcctccccgctcagcttttcgatgttgtgacacggcggccaatggcaagagtcatgacatatggctttcagtcttttatagacagagactatggcccaatggcgttcgaggctctcgggaaagtctttctcaaaaacctcgcgacattgggcactccttctgatgctaagcctacgatactcgttggccatggtgttggaggtctggttattaaacaggtaaagcgatcccatgggccccacaagatgcggtcactgaagaattacacaggctttggtgagtctgtctcagtcacaaaaagaagcggatacgaatattctcgatgcaattcgcggcgttattttcctcggcgtacctcacgatggcatggatatagcatctctcggccttgccccaggcaacggcggactcagtcagcaactcatagagtcgttgagtcgagaaggatctgaggtcctgaagcaactgcatagtgactttatgcaagctttcgctcaaaagtatgagatcgagattttcagtttctacgagactctggaaacgacagtcgtgcaacaagtaaggcatctagattccctgttacacaaactagctactgattagtaaaaaggatgggagccttcggtatggagttgtagtgtcgagggcttcggccactcattgccatccgtgtgaggatgatagcctacaaacatgcgccatacctcgaactcatgcaggcatggcaaggttcgagccgcacgatcccgagtacgacgctgttaggaacaggctactcaagttagtacggcgagcaacgagtgattgggcctatgtaggcagttga

SEQ ID NO: 172 - protein, 386 aa, Hypocrea jecorina
MSQRTTFRVQRVPLDWRASRLRACLEQHDPSSSPVIRSLALEVDRRSYTATVDFRSRPLVTQSPKPWDISLGDFGENDSSDNGYITLDDDLLGITTLYLPSDENHKAEYVIIALGSISGCPLDSFEDEASSHVWLRDVLPAQLFDVVTRRPMARVMTYGFQSFIDRDYGPMAFEALGKVFLKNLATLGTPSDAKPTILVGHGVGGLVIKQALVSLSQSQKEADTNILDAIRGVIFLGVPHDGMDIASLGLAPGNGGLSQQLIESLSREGSEVLKQLHSDFMQAFAQKYEIEIFSFYETLETTVVQQVRHLDSLKKDGSLRYGVVVSRASATHCHPCEDDSLQTCAIPRTHAGMARFEPHDPEYDAVRNRLLKLVRRATSDWAYVGS

SEQ ID NO: 173 - DNA, 596 bp, Hypocrea jecorina
agcgaaaaatgagtagctgggcgtgcagctgtcgtgcatcgtgttcgcgggtagaagatcacttcctggaagtgcttaggaagaaatcggggtggcgcacggtgctggattgcaagctttggtggggagagtagaggaagctttgtcttattcatgagccggcgtgctggtccatggttgttcaagatggtccgatgggcgagaatgagatgttacctacctaaggtagagacggggacgtttccatgttggtaaagccgtcaattcgcgggaatgcccgcagtgatccattccaggttccaggttgtgtcccacccgaacacagcggttttggttacaggcgctcgagccactaactgccctaccagatcggctaaatgcaggggtgccccagattcaatacgatcaaggtccgtgtgtcctcaccttgggtaaggtgagttccatcaccgcatctccatggcatgtgttaggaccttgtcgcatttttcgcgtcatttgtgcctccagttgtctgcactctcctctgtcgattgatccttgacaatctataaggttagattcagcatgagttcttcgacttggatatctcctat

SEQ ID NO: 174 - DNA, 1596 bp, Hypocrea jecorina
tagaattgagagaaacttggtatgaccacaaagcaagtgatgttcaattccgaaatggctacaccgagggatcactagcctccaaatccaattgttcggtgaaggcccagtatccgaaagctgccaacgcgtcaggaggctaagctcttgagttgactatatgtgtgtggtgcctcgtatagcacccgagaggtttttgcgacgccagccatgatcgtgagcaagtaagaccaagctgcttgagccggacgatgggtacatattctcggatatggtcgccatcagcctcccctagattgtgataatgtgctgaacgcctgttaggcaaggacaagattgctgcaatcaatcatagctaactgcttctcttccttatcttatctctatcagaaggcacaacaaaaccttgatatgtccccaaattacccacttaagctctcagagagctgccgctggaaaaggcatcgcactcgtgtctcaagaacaagacgggcaatgctgatagccgaagcttcgaatcacagactgaacagggttctggatcagacaaagtagatgttggtaaaggtttcgacatacgtgcgtacgtaccgcaagagccaggatgatcatcgacgtagtcagggacttgtgcttactcaacggcatatgtccaagtttctttaagccattcagggtatcgcgctcagggagatttacaagggcatgatggatagtataggtgtactgcactttattacatacctagtgatagagtgtcttgtctcgatcaactcccgatgccggctgacgcattcatcactctgagtgtctgttgtcaaagttgacgagatcaggggcggggatgagtcacttgtgtccgtagacacgacgagaatggtcaagaagagacatactgccttgggcatcacatctaaggaaacctagtgtctatcacactatagggaaagtatggaatgacagtcttatatcccattaatttgctgcgtatactagatatctctgtccaaagacatccccaagcgcttggctaacgcaactcatcaagacgatgacagaccactcgacaagcaaacttgttggaattgtccttgtgtaatgcctttcacaagtatgactgggctaagttggaccagcctctcgatcattgcggattttagtatctactatcatcatgttacgacaatttggcatagcgtacgtgaataccgtcgcgcgaggttgtgaagatggaaattgacactaccgtccttcacatttcccaatttgtcaatccgcgggaaacgatccgtcccgtttatatcatcgaatgaaccaacacagaagcgcattcacagactcgtcgccccggcattctcgactctcttccatctacccaagaatccatctatttacatctgactcaacttttctggcaagcaccaagataagcctgatattggcaagttccagccaagcatagccaagagtttcattttcccttccccagcaagctcagtaactttctgccagatacttacttgtaacttgaatatgatgctcaatatggtcactctccttggtatgaagattgtttcattcagcctgcgggtgaag

SEQ ID NO: 175 - DNA, 20 bp, Artificial sequence
  Primer hphF
ggatccgagagctaccttac

SEQ ID NO: 176 - DNA, 20 bp, Artificial sequence
  Primer hphR
ctcgagggtactatggctta

SEQ ID NO: 177 - DNA, 49 bp, Artificial sequence
  Primer Trire2_67350 5F
gtaacgccagggttttcccagtcacgacgcctagcctgctcttattacc

SEQ ID NO: 178 - DNA, 49 bp, Artificial sequence
  Primer Trire2_67350 5R
catattgatgtaaggtagctctcggatcccaagctcgtgagacagtacc

SEQ ID NO: 179 - DNA, 50 bp, Artificial sequence
  Primer Trire2_67350 3F
tattccatctaagccatagtaccctcgagcctttgtcttctcttcgttcg

SEQ ID NO: 180 - DNA, 49 bp, Artificial sequence
  Primer Trire2_67350 3R
gcggataacaatttcacacaggaaacagcgagatgacacttcagggagg

SEQ ID NO: 181 - DNA, 49 bp, Artificial sequence
  Primer Trire2_76887 5F
gtaacgccagggttttcccagtcacgacggatggtagtttcttggctgc

SEQ ID NO: 182 - DNA, 49 bp, Artificial sequence
  Primer Trire2_76887 5R
catattgatgtaaggtagctctcggatcctaagaagagccttctcgtcc

SEQ ID NO: 183 - DNA, 49 bp, Artificial sequence
  Primer Trire2_76887 3F
tattccatctaagccatagtaccctcgagcttggagaggtactcagagc

SEQ ID NO: 184 - DNA, 49 bp, Artificial sequence
  Primer Trire2_76887 3R
gcggataacaatttcacacaggaaacagcgacaaggagcagaaaagacg

SEQ ID NO: 185 - DNA, 49 bp, Artificial sequence
  Primer Trire2_105832 5F
gtaacgccagggttttcccagtcacgacgcataccatcgtgtgtactgg

SEQ ID NO: 186 - DNA, 49 bp, Artificial sequence
  Primer Trire2_105832 5R
catattgatgtaaggtagctctcggatccagatctaataccccaccagg

SEQ ID NO: 187 - DNA, 49 bp, Artificial sequence
  Primer Trire2_105832 3F
tattccatctaagccatagtaccctcgagtgtatgctttggccgctgac

SEQ ID NO: 188 - DNA, 49 bp, Artificial sequence
  Primer Trire2_105832 3R
gcggataacaatttcacacaggaaacagcctacatacctacatgcgacg

SEQ ID NO: 189 - DNA, 49 bp, Artificial sequence
  Primer Trire2_59270 5F
gtaacgccagggttttcccagtcacgacggaggatcaacagtctacagc

SEQ ID NO: 190 - DNA, 49 bp, Artificial sequence
  Primer Trire2_59270 5R
catattgatgtaaggtagctctcggatccaccaccccactaagataagg

SEQ ID NO: 191 - DNA, 49 bp, Artificial sequence
  Primer Trire2_59270 3F
tattccatctaagccatagtaccctcgagggtaggtaggtagctcatgc

SEQ ID NO: 192 - DNA, 49 bp, Artificial sequence
  Primer Trire2_59270 3R
gcggataacaatttcacacaggaaacagcgagtgtcatgtgagacaacc

SEQ ID NO: 193 - DNA, 39 bp, Artificial sequence; identical to SEQ ID NO: 1
  Primer MAT1-1_InFusuion fw

SEQ ID NO: 194 - DNA, 38 bp, Artificial sequence; identical to SEQ ID NO: 2
  Primer MAT1-1_InFusuion rv

SEQ ID NO: 195 - DNA, 41 bp, Artificial sequence; identical to SEQ ID NO: 3
  Primer hph_AvrII_fw

SEQ ID NO: 196 - DNA, 38 bp, Artificial sequence; identical to SEQ ID NO: 4
  Primer hph_AvrII_rv

SEQ ID NO: 197 - DNA, 20 bp, Artificial sequence
  Primer 1-2_replace_cassette_fw
tggaacgactttgtacgcac

SEQ ID NO: 198 - DNA, 20 bp, Artificial sequence
  Primer 1-2_replace_cassette_rv
ggcacaagaggacagacgac

SEQ ID NO: 199 - DNA, 42 bp, Artificial sequence
  Primer repl_Trire67350_infusion fw
taaaacgacggccagtgaattcaataaagacggcctggaaac

SEQ ID NO: 200 - DNA, 41 bp, Artificial sequence
  Primer repl_Trire67350_infusion rv
aggaaatcaaagccgtctagattccgcataccacctacttg

SEQ ID NO: 201 - DNA, 43 bp, Artificial sequence
  Primer repl_Trire76887_infusion fw
taaaacgacggccagtgaattcttctctgatcgttgggctatg

SEQ ID NO: 202 - DNA, 42 bp, Artificial sequence
  Primer repl_Trire76887_infusion rv
aggaaatcaaagccgtctagatgcctcgataagacaaagtgc

SEQ ID NO: 203 - DNA, 44 bp, Artificial sequence
  Primer repl_Trire105832_infusion fw
taaaacgacggccagtgaattcatgtagagcggcaccaaagagc

SEQ ID NO: 204 - DNA, 41 bp, Artificial sequence
  Primer repl_Trire105832_infusion rv
aggaaatcaaagccgtctagacaatcgcgtggctttcgttc

SEQ ID NO: 205 - DNA, 44 bp, Artificial sequence
  Primer repl_Trire59270_infusion fw
taaaacgacggccagtgaattccgccaggttgatcttgttctac

SEQ ID NO: 206 - DNA, 43 bp, Artificial sequence
  Primer repl_Trire59270_infusion rv
aggaaatcaaagccgtctagatcgaagtgtaggctggaatgag

SEQ ID NO: 207 - DNA, 20 bp, Artificial sequence
  Primer Trire2_67350 67350_fw
aataaagacggcctggaaac

SEQ ID NO: 208 - DNA, 21 bp, Artificial sequence
  Primer Trire2_76887 76887_fw
ttctctgatcgttgggctatg

SEQ ID NO: 209 - DNA, 22 bp, Artificial sequence
  Primer Trire2_105832 105832_fw
atgtagagcggcaccaaagagc

SEQ ID NO: 210 - DNA, 22 bp, Artificial sequence
  Primer Trire2_59270 59270_fw
cgccaggttgatcttgttctac

SEQ ID NO: 211 - DNA, 18 bp, Artificial sequence
  Primer in geneticin rv
atcccgaaagcatcaccg

SEQ ID NO: 212 - DNA, 11653 bp, Artificial sequence
  pFSG_complement_67350
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcaataaagacggcctggaaacggagcggcttgagcagctctctttgttcccaactgcgtgaccaaccagcccgcatcccgcatcccacatccagcccaaacctctcctgcatccgcctgcatcacccattacgcctgatcctccaaacaggagcatcccctaggcggtacgaacaagcgccgagctaatcagatcagcccctcccctaacgctctgcagcacatcacagaaacccgttgtccaagcttgcccttacatgcaaaaccgtgacgctgccctcttccgttaggctgctcagccttcttccctttttcaacctcatctcgttgctgtagcctgtcacgaccaagttcctgcatctctgggaacatcctccacggcatatcacagcttacatcccgcccggcaatcgaccctcttcgacgctcccgcctccacgataccaacaacctccaccatccccgtcgacggcccgaacggaaccggtcacctggtggattgcagcgctgagccttgtgtccgggagtgggcagtagcagggtttcatgtcatgatcgatacctgaagagcgccgcagcttgccgccaccttgtggactcatccctcgacaagcgttctcggaagaggtctgaccttggcttggcgacaggattgtgacaccaaagccggtactgtctcacgagcttggaggggcggaacagtgccctctgagctggctcgaggaggaggccgtctagaccggccaatataagcttggacccgacagagtcggccgtcgaaacacatcgagagtaaaccgcagacatgtcttccacatcgcatatccagactgtctccaatcggtccggcaagtcgtcgaccgctcggggccgcccagcgccgcccgagttcgcacagatgccgtccgccgcggacctcaaatacttcatcccgtctgctgccacggcgtccatcttcctctatgcgcagggaccaacgatagtctgttgccatcacgacacgctcaccatcgaccggaggttctcacgccatgtcgacgatgtccagctgcttgccgtggataaccagagcgacatgggcgctggccggttcgtcgtgagctatgacgctggccagactgccattgtgtgggatctaatgacgggcgatgagatttcgcgtttcgtttcgtacgagacgctcacagtcgccgcttggatgcggaatggaaacgttgctttcggtgagcggaaccagagatcgccctccccctctccccttaagctggtgacatgaggtggctaacggattgggcttccaggcaacacacagggaaacatcatcatgtttgaacctactacatccgagcatatctcggctcggacgctagaccagattgcagtgacagcattagccccttcgtctgactgccggacctttgcgatcgggtaagttggtgttcgaccatgaatcgagaagtctgtcgcgaatgtgccacggcgtactgattccatccgatgtagctaccagaacggatctctcttggtcgcaactctgcagcctcggttcaccatcttacacaacctgacgacctcgagagggccatcgcccattgtcaccctcgcctggcacgcgtcctcctcgaggcagaaatcagacatgctggccgtacagacgcacgatggcgacctgcgggtctggagtgtggccaagtcgtacagcgccgaagatcccgccaaggtcgtcagggtgctccgcaggaacgagaacttcctggctgggcccaattggatggggtggtccaagaacggccgcatcatccaatactcggactcgtaagtcccctatcaactggacacagcctaagcgcgcggcctcccgcttctgctggtttggttttttgttgtgctgacctcgttgtgcagggaaacgttttcgtgggacgtgagaaccaaacatgtcacaaaggactccatcccgacccttgagcatgttaaaggcctggccgtctatggcccaggagccagtctcttcacccttggaccgaacaacaccgtgcagcagtttgacctcaactccccagccatcatggtggcaaacgtgcagcaccccgcgggcgtccttccgccatctccacccacctccgaggagacagggggcaggtcggtgcactctgccacgaccattcatacctcggaatccgagtcgagctctgtccccctcgagatgggcatctctgaaagcgatgacgaccacctatcccctttccagcggctagcaaagcgcaatgcccccgaagccaggaacgaggtgtacgatacaggcagcgcggcctctagccagagcggcgtgtcatccttgtcaaagtcttcggccagctctcgtacgcctggcaggcaggccagctcgctcaggtcgcggggaatgacggaggggacatacatctccgctggttcatccatgaaaacttcgacagttggccagcgcgaggcggacaactactccatgggatacacactccctagcaccagcggtccatcattggcgtcgtcccggtccaggcatcggccctctcgtctcagacacgaagtaccgaggagtcctgacgaggccaacgtgcaggacctgttcaaatacactcgctcgcggcttagcgacctcccgtacaagcacccgatgccaacgcaacgatctcatcctaccaatgacgatttgcgccgacagatgctcagcactatctttggctggaacaaggaagtagaagacctcattcgagacgagatgagtcgctatcccgcagggtcggcgaaccgaatcttgctagccaagtggctgggcgacattgacgcagacatcatggccgcgggttcccagaacatgacttcccaagactggatgctgctggcactgagcggcattggcggccaggcatcccagcacaagctcggccgagtctatgtccaacgcttgctagagaatggcgatgtccatgttgcggtgacgattatgcttgggatgggcgactataacgatgccattgaggtctacatctcgcacaagcggtatatggaggccctcattctcacctgcgtggcttttcccagcgtctgggagcgtcaagctgccattgtgcgcaaatggggtgagtgggcggtcaagcatggccagcagcaactggcaattcgttgctttgcctgtaccgaccaggagtcctcggagccttggacctctccatcggctgcccagctaaacttccaaaacatcaccccgagcatccccgaggtgctgagccctccgctgtcgcccccgggcattcagagaggcccccagcgcagcgtcgccaaggcatcggcactgaagctgattacgtcctttggagatcccacccaaaaggccaagttctactcgcaggctgacggcggccagacaccaattgcagctggagtgacgcccattgccgagtcggccatctctccgggaggcgcctatgatcccgcaactgcgttcctccggccgtcgggcaatagcaggttcaacacgccaacatcagcccgccctatcggtcagggcttcagccgcggacggctgccctccatcggagaagccaacaagcccctggataacattgcaagcattgtggacgcaccccagaaacggccgagccattctcgcaagtcgtccgcccctcaagataacatggcaaccgggctcgccatgcagcgcgctgctacggccagcccaatgatgatgagggaccagtaccagcgcgccgtgcaagggtacggaggagagcgaccgccgtctcccgaccataacatcatgagcagactgcaagaggtccattcggcacagcgaaacggctcccgtgaccggattcctgctcaccttagcctgcagctgcagacgatgcagccgccatcgatggaggcaatgtctcctgagcaatccggcgcctcatccgctcgcttccactggccgtctcgtcgccgcggtactggtcctagttccgcatctgtggccggttccatgacatccacctccagcgctggccggagtcacaaatcgaacgctcgacaaagggatgattacatccatagcctggaagcggctcagcactattccaggagagctggaagccggaccggaagcaaggaacggacacgagacgcgtccaccggccgccacgccagccgagagcgacgaaccaagtcgcgcgacccttcggaagagcgcggcagggcttcagccagatcctggacaaggccaaagcgatcacccacatccccagttccaatgtcccccgaagacttggccatgctgagcaaccggacattcgacaactccgtggaacccctcacgattcgaaaggcgagcgtggcgaaaggcaaggccagcgggcggacatccagccgcggaaggggtggatcagtaccgcggtcaccgccgtccccggtgccgctgtcggcaacagccctgcattatcagggatcggaggacgaggaggactttagagcagccatgcgggcgcaggaagagttcagggccaagcacagccgcagcgtcggccacaacgtcaattctcccgccgtaagccggcgtgagcattcggaaagccgacgaaaggaagcgactgagactcgagaggctgcacccgtggtcttgagccagacagtatatggacgagccgcttccaccgagcacgccggcgatctgaagaagatgaaggacgagagacagcggaagaaggaacaggctgcgcgagagctagaagagcgtaggaagtctctggccaagcgacagctcggtccccagattccccatccaagccagatctctcccgggagaccgccggttctggtagaggccgacgatgaaaagctgccggatgatctgccgccgcgctctgcaacagaacccccgaggacggcggagccgccgaggagcatgtatgctcaaaacaggccgcagattggcctgcctgccactcccaaggcgatgaggctcattatccggtctgacgagaatcagtacgaggacctccctgctccgccggtgccggcgacgttttctcaaaagtattcgccgcagaactcaccccagtactctccgaaatacacgttgggcagtagtgtttatggagaggagcagaagcagcagcagcagcagcagcaacagcagggacagcagcagcagcaacaacgacagcaacaacaacagcagcagcagcaacagcaacagcagcagcagcaacaacaacaactctttcatcagaaagaggaggagccgccgttgacactgctgccatcgactgtctatcagctgccgtccactgtctaccaaccgccgtctcgccccatgattccgcgaagcatgtcggcaccgatccctgatgagccacctcacgcaattcgatacgggagaaagtcgagtgctaacgagggcagaggcctcgacgatattgtagagacggagtggcgtcgacaagtgaacaacctggtgccgcctccaccaccacctcccccttcggcgcccctgactttcctcaaggagctgcagcatctagccgtgccgccccctcctccgccagcaccgctgccacacgtgcgacgccagccgcccgtggctggaacactggcctcgggcatgatcgaaattgtcatggacgatgacgaggcagaagagcccatgtcggctgctcccaacgacggcatggtgccggtgctcgcccagcccgaaccccctgtcaagggccacaaccgcggtcgcagcctcggggagggcagcctttccgggcgtaggaccaaggcgacggagcgcctccgctcgggcagccgcagccgcaaaggatccatcggcgtcatgtcgccccctctcgagatgtacggcggtgagggcaatgccaactcgctgaaccagctcaggtcgcccgtggtgggcaatcctccgcctgtgctgtatgaccgggacgccattcgatcgcccattgaggggcatggccgcaagatgtcgatggggctgcacgagaacggcatgttttaggcttgggtgggcgacttgttgtgtcgcacaaggagttggggcctattcggtattcgctgtcaggctgttcttcgatgcctgtatacgacgcctgcatacgatgcgtttgtcgccatgactttgcttgctttcattggctctgttcttttccgatcgaggaggtttcttccccccccgtgcctggcatctgtgagcatgggacgatatcttgtgtgtccctttggggcaatatttcttttcaattctgatagttggcatggccattcctttgtcttctcttcgttcggtctttcagttctaaagccctccccccttcctttccacttgaggaaagaagaagctgtcttacttcttatccaagtgtgttttagtgagcatgtgcaaaactgggtgctgggatgctttctcttcatttgctttggcaacgtcattatgtccaggggatggttttttcatggaatggcggcttgcaaataccatgcaagctatgtatatcccggcttgaagactcttttctcgctttccttcactgcatctttttttttctctctctcttcgattctttatgactgacgacgggcacctctttttctttttctttttctgggcggaggtataagagaagcaagtaggtggtatgcggaatctagacggctttgatttccttcaggtcatacgaggcttgtgcaatggtctccgcatggatcgctgctgttctcctatcaaactcggattttgtcttaggggatggcgtaggaaagacgctgccgcggttcagaagcacctcgatgctatcaggatgtgacaaaaacgactcgaaaacccggattcatcggtgatgctttcgggatcgcaagcgtaaagaaagactctcttccaagacctagaagtatagcaaaatcagcagcagaccatcaatgtatagcgaatgcgcccatacaaaagctgaacgtccccggagaagcacttgtccagggacgggaaataggcttccggaacgggagccattggcagcacagctatatcattctaagtaaacaaatgtaatgagcaagcggacggagtgctgaaacctccgtatgcctgaagccgacgaaagcgcgttggattagaggtcgacagaagatgatattgaaggagcactttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtgaacgacccggtcataccttcttaagttcgcccttcctccctttatttcagattcaatctgacttacctattctacccaagcatcgatatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatggttgcctagtgaatgctccgtaacacccaatacgccggccgaaacttttttacaactctcctatgagtcgtttacccagaatgcacaggtacacttgtttagaggtaatccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 213 - DNA, 8384 bp, Artificial sequence
  pFSG_complement_ 76887
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcttctctgatcgttgggctatgaatagtgctgggagcgaatccatcagacatctcactggaatgtttaataccaccagacttggcattgcttttatgcccaatatgaaggctcaaaacttagcagcttgaatcgcttgttaacagacctcatcaaaagatgctccatcagcctttgaaaagttggaggcgggagtcgatccacaaggttcgatgacgacggaggctgtcgaggccttttcccagcgatccgaagactccccacagactccgcatgctctgatgctcagctggctgcttgattgggctgacgctccatgctctccataatctccataccagcaacaagctttttacgcatatcttgaagaatgacagaactttgatactataagcatttataaggtagtagaatagttcttcgtgtaggtaggtagcagtagtactaggcaactctactctgaggcaacctcgtacgtagtagtagtagtgagtagcttgtcgagcctcctccaggccacccgccgcttgatccgcctgaaatagcgtcgcgtagctgatgaaccgagcgccacaaagcggaaagacgagcttggcggctcgaatccaggcggaccggagcaataaagtccagcactagtgggtgtccaagaggagctgcgccgcgttgctccagcttcagctccggccaagctccaaggttcaagaaagttgtcggcaagacgcgactcggaaaggctgtgggcgtctctgctcctatggagcagtgcagccaccaggccagaggggctgcttcaccgataatggctaggggaggaggccagatgaatggaagatgagatcatgaaggaggacgtaaaggctcttcttacaaatagtactacttttaccccggaaaccggacgagctggcaacgtttgctctccttgtcccgtcactttcgacccttgtcgccgtcgtccccgctagcagcaagatcgtgccgagatcttgctctgttgctttggtggtttgccgtgctctgttttcgttgtcgtacgaactcagcctacctacttattctttctcttatcctaatacttcattctgtattactcccgttctcagttcttcatccctttgcttccggtttttgatcaatatactttacagggagaggagaagagaagagaagcggaagggaagtgacaggaagagagagagaggggatagaagaagagtcggcagagctctcagcgcaaccatgaggccgccaacgtcgttgtcagcagctctgacgctgctcctcgcgacggattacattgaagccatcgctactcccgttttcccgagggcgaaatctggggatgggtatttggcgattcccgtgggaaccatcccgaggccgcacaaggtcggcaagagaagcgccatcgatgctacgctacagaacatggactttttctatgccattcaaggtaatgcatcacctttgttaacaccaccagaagcttctgttcagctcgtgtctctatcgtccgcttttaagtgcactatctacggtctgcaaagtgtacatgctaataaatggtcggcaacagtcggcatgggaacgcctccccagaatgtgaccgtcctcgtcgacacgggatccagcgagctatgggtcaatcccgactgctcaaccgcgccgtcccagcaacaggccgacatgtgcgagaatctgggccagtacaaccccaggaaatcaagaacaccgcccgtcggcccgtttgggcgtgaagagatcaactatggcgaccctacggaccagtccacgcagacgtcggtcgacattacctactatgccgacacgctgagctttggcagcatccaggtcaagaaccagacgtttggcgtcgtcacggccagcgacggccaggcgcagggcatcatgggcctcgcacccgacgtccggggcggattcccgggagacgagccgtacagcctgctgctcaacaccatggccgagcagggtgtcattgcaagccgagtctttgcactcgatctccggcactccgactcggagacaggcgccatcatctacggcggcctcgatcgcagcaagtttgtcggctctctcgaagcacgtccgattgtgcgcggcatcaagggcgaaactcggctggccgtcaacctcacgacgctgggcctcaccctgggccggtcccagagcttccggctctctgctgccgacaccaacgtgatgctcgactccggcacgacgctcagccggatgcacgaggctgctgccattcccatcctcgaggccctgggcgcccaagacgccggcgagggctacttctacgtgccgtgctcgacccggaacgctggcggcagtgtagatttcggcttcggcaacaaggttgtccgcgtccccttttccgactttatactgacgggcgaagactcgagcgactcagactattgcttcgttggcatcgtcatcaccaccgaccagcagattctgggcgacacggtgctgcgggccggatactttgtctttgactgggacaaccgggaggttcacattgcccaggccgcggattgcggcagcagtgacattgttgttgctggcagggggtccgatgccgttcccagcgttcaggggaactgcaatgagaacgaagcgtttcccaccggctcaggaagcccaacggtaagcatctcttttgtccaaactgcgtgacaaccgacgactaaccacaagtctcgctgcagatcactgcatccaactccggagccaccaacttgatcccgacctcggccttcacgacgacgtttacggtgacgtcctgcccggtcttcgacatcaactgccgcaccggcgtcgtcacgacgcggacggttcggccagctgaagccactgccgaacctacaagcaccagctctcccagcggctccggcagcggcgacggggatggcggaggtgatgaagacgctggtgtacggcttgtcccttttacctgggtgctcgtggcgctgggcaccctggcaatgtttgtcaacattgtataaattgtccaggaggtcatttctcttggataggtactcagagcttgtttacacgtttcgaagcttttgtatatacgggtgagctggatcggccgacattaatgggcattcgcgattaggtagaggatttatcctaggatcttgaatatgaggcaggggatttgaatagacggacgatgcattgtctttggttttctgcaaaaggcaccagcctggtcaacgcgtaatacccatgacattgatgattgtaggtagtatgtcatgtagaaacgggtctttgtgaagtggaagtatcagtaagccgtatagttggccttttctgtctcacggggtgactgcatgcacctttgtcttgtcgaggcatctagacggctttgatttccttcaggtcatacgaggcttgtgcaatggtctccgcatggatcgctgctgttctcctatcaaactcggattttgtcttaggggatggcgtaggaaagacgctgccgcggttcagaagcacctcgatgctatcaggatgtgacaaaaacgactcgaaaacccggattcatcggtgatgctttcgggatcgcaagcgtaaagaaagactctcttccaagacctagaagtatagcaaaatcagcagcagaccatcaatgtatagcgaatgcgcccatacaaaagctgaacgtccccggagaagcacttgtccagggacgggaaataggcttccggaacgggagccattggcagcacagctatatcattctaagtaaacaaatgtaatgagcaagcggacggagtgctgaaacctccgtatgcctgaagccgacgaaagcgcgttggattagaggtcgacagaagatgatattgaaggagcactttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtgaacgacccggtcataccttcttaagttcgcccttcctccctttatttcagattcaatctgacttacctattctacccaagcatcgatatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatggttgcctagtgaatgctccgtaacacccaatacgccggccgaaacttttttacaactctcctatgagtcgtttacccagaatgcacaggtacacttgtttagaggtaatccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 214 - DNA, 8607 bp, Artificial sequence
  pFSG_complement_105832
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcatgtagagcggcaccaagcagccttcagagttctcaagcctcatgtataaatgctacctcaccaggtgctatggaagcagattgggtgcagcgaatgcctcatcaatccatcaagatacttcaacaggagctcaccaccgaaagccactgatataagctgaaggaaaggcagtctaaacagcgaaaacaaaaacaatgagttggcagcgtaatcttgacgcccagatatctacatctacattacagatgctgtcgacttgactagaagtttggtcaaaacagggtagtcgtggaacggagacgagcgtttgcaattgggcgtatgacgtcattgcgtgagccatcagatagatgttgcatggagcgtaatggttgatcttggttgatcgacagataagataagcacccgcaaattttcgcggggcacttgatgcgcaatatcgatacccgataacgataacactttgatgttattggactctgtacgcactgtttttgctgccaagattggttgttgtctttatttcatacgcgttccgacagaatttgcatacatgcagcgattggaaagagccttcagccttcttcttcgtacctgaccttgtgatgatttgctgcgagtaacttcgtatcttgcgagtcatagacaaggtggtgagggtgaggcggggcatcgtacctggtggggtatcagatctgctaaatgttttcgtgctatcttgttaggacatcaaattcttccgagtgtctcatcgctgcgctttttccacgacttcgccgaactcctgcgaaaatcaccgagccgtcgctcacttgagcaaacgaagccgagtcacacgcttccagctctctctcgacgttcaagatgagcccgaaacccgtcatcggccttttgggaggcggccagctgggccggatgctgtgccaggccgcggctcccctcgatgtcgaaatcgccatcctcgacgccgagaatgcccccgcgaagcaggtcaaccacaacagccgcaacatcaatggctcgtacaaagacgcggagaagatcaaggagctggcctcccactgcagcgtcctcagcgtcgagaccgagcacgtggacacgacggtgctggaagagattgcgacgactacaaaggtggccgtgtgcccgtcatggaagacgattcgactgatccaggacaagtacgagcagaaggcctacctggccagcaagggaattcccgtcgctgagtcggtggctattgagggatctggcgatgccatgctcgcctctctcaaagccgtgtctgccaaattcggctatccctggatgctcaaggccaggaaggactcttacgacggccgagggaacatgaagatctctggcgaagccgacctcgaacatgctgtcgccgagtttggcaagtttggctgctatgctgaaaagtttgtcccgttccaatgcgagctgtctgtcctcgtgattcgcacggaagacgacgacggccagaccaagcgcctgctgccgtatcccgccgtcgagacggtacatgaagacaacatttgctcacgagtctacctgcctcctcggaccactcctgcttctgcctgcgagcaggcacagaaggtcgccagcgacgtcgtcgacaagctttggggaagaggcatcttcgctgttgagatgtttgtcacccaggacaaccagatccttgtcaacgagattgccccgcgaccgcacaactctggccatctgttcattgaagcggttccatacatgtacgtattcacccgttgccctgctggttactgctctaacaaggctgtatattaggtcacagtacaaggcacagctcacctcgatcctcgaccagactctcccgcccaaaattgagccgtacgttgcttcgagtatcatgatcaacattctcggaggcgccaatcccgactcccatctcccgcttgtcgagaaagccaagtccatgtacggagacaagatggctgtttacgtccacctttatggcaaagagtccaagcccagccgaaagattggacacatcacagttactggcttagtcgccagcatagcggagctcgaagagtttgcgaaaccgctggtggacatggccagcgacatcagacaggagaggctacaatcgcgcaccaaggcattgcggccagaccaggcggtttccaagcccgctcaggcgccgctggtccttgttacaatgggctcggactcagaccttcctgtgcttaaggctggcatcgacatcctgaaccagtttggcgtgccctgggaagttgacatcacatcggcgcatcgcacgccggccaagatggctgatgtcgccacgaaagccgctgctcgcggcatcaaggtcatcatcgccgcagctggaggagcagctcatttgcctggaatggtgtcggcctacacgccgctccccgtcattggcgttcccgtcaaggccacgcacctcgatggtgtcgattctctctattcgattgttcagatgccggtaagtacatacaacctttttggcttcctttccccttccttgtacgtgaggctgacgagcgtatagcgcggtgtaccgacagccacggttggcatcaacaactcgaccaatgcagccctcctcgcaatcagatgcctaggtgcctttattcccgaatacctcgagaaaatgaaggcgtatcagctggacaacgagaagcaagtggaagagaaggcgaaccgactgcgagagatgaacgtcgaggcctaccttgcgcaaatgaagaaatgagggagtcttaatttgacgctgcgagccagctggcccaacctcgatatcctaggctgaccgtgaaggacgatcatgcaccaaaaccagttcctgcgtgcataacttagaatcgcattcggaggctttgcggatcgaaccatcgactcccagcaattgtatgctttggccgctgacaccacgcctcaacatgcaacattcgttgtggcattatttcgaatcacgaatatctacagtgtcttatatatatctcaactttggaaaagaatcaacccacttaatgcctcacgaggcttctcattagatagggcggtggcaaatctgtaaagcaggcgagatcacgcaaccaagacatgatccggtgtcctttccctgtggttgatgagtatccaatcgtgagcatatggcagcgagctgtgctctccaggcgcccgagtggaaggcatgcctctactcttatataggccaatccaaagtttttgagcaacaagacttttggcgtataacactagcagttgaacgccccggggataggagtcttcgcactgaccactcgacaactagagtagtcaatcggctgactatcccccgtcctgatcatgtgaatctactatcccactcttcttggccctcaggagtccctctgaagggctctctgggggacctcagagactccatttgtttgtgtgactgtccgcgaagctatgggctacaaggcagaccatcatgctcgcctgcgccgttgtcaaaacctcgtccttgctcgagcagcctgttaatggcctcttcgccaccggattgattgtggcaactggaagggcctcagattgtgaacgaaagccacgcgattgtctagacggctttgatttccttcaggtcatacgaggcttgtgcaatggtctccgcatggatcgctgctgttctcctatcaaactcggattttgtcttaggggatggcgtaggaaagacgctgccgcggttcagaagcacctcgatgctatcaggatgtgacaaaaacgactcgaaaacccggattcatcggtgatgctttcgggatcgcaagcgtaaagaaagactctcttccaagacctagaagtatagcaaaatcagcagcagaccatcaatgtatagcgaatgcgcccatacaaaagctgaacgtccccggagaagcacttgtccagggacgggaaataggcttccggaacgggagccattggcagcacagctatatcattctaagtaaacaaatgtaatgagcaagcggacggagtgctgaaacctccgtatgcctgaagccgacgaaagcgcgttggattagaggtcgacagaagatgatattgaaggagcactttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtgaacgacccggtcataccttcttaagttcgcccttcctccctttatttcagattcaatctgacttacctattctacccaagcatcgatatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatggttgcctagtgaatgctccgtaacacccaatacgccggccgaaacttttttacaactctcctatgagtcgtttacccagaatgcacaggtacacttgtttagaggtaatccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 215 - DNA, 8796 bp, Artificial sequence
  pFSG_complement_59270
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattccgccaggttgatcttgttctacagaggccagcgactcagcataattgcttgttcgagcggattagacagatcagtgcagccctcgtcaggcacaaggcacgagtcgaagatatgccccaacccgcagctccagcgcccgtacccaagtcttgttgcctttgtgccacattctgtacccagctgcctaagacgtagcattggacatgtgatgcagatgtatttgtagggggtatcgggaagtgcccgtgtgcttcgcgatgagattccgcagatttacaccctgaaccgctaccctacaataccttacatcttacaagtctacaagggtaaaatacgtcggcatgtgcgagtaccaaaccacaatatgccaacttccgctatctactcacctttgatatattccccacgtacaattattctgccttttcgttgggttaccgctactggtcctcggctgatacatgaaggcggattatcatcctggtgttgtggatcagctgcaatcgaatgggctctacgcaatcatatgaggaaacatcagcataaacaataatatgctaaacgtcagattagagaaaagcaatgagtagaatgacaacctgacgagagttcacgttgtgaacaagcctcgaggctgttcaaggctcggacccaacagggaatacttactactaggtatggagatcaagcctcgtaaagccgggttatgactctgttcagcaccttatcttagtggggtggtcgccggttgactcaacatcattccagcctcgtcatagaggggcaactcttcagccttttctaccaccgcaactcccctcttgctcgcgacaaataccttggtcgcacagctctttgctgttcacgcgtctttcttttgcttcgacagtttaaatacagaagccgccttgcttgccgtaggattcaacgacgctccatacccgcagcctccccgggacttgacacaatggctcagaacccggcagacgagctccttcggcgtccgttatatggtaagtaaaagcactttgtcgcgccactggcaaggcctaccaataccggccgagacacgggacacgagacatacagcttataggacacgcgctgtttcttgcccgagtctcgattcgattctacgatctctgaacaagtgctgacaacttgcgccaacgcggtcttagtctacgatcttccaccagaaagcctcgcaggcttgacgctgaaaccggacgcagacgccatcgccatcgaggaacccgagacgtcaacgactcccagccaggcttcggactcgtcctccgacagctttgtcggttcccaagcatgctctctctgcaagctttccttcaccaccgtaatagaccagcgaagtcacatcaagtccgatttccacaactacaatctcaagcagaagctgcggggtcagggcccggtctcagagaccgagttcgaaaagctgattgagactctggacgaatcgctctcgggctccgactcggaagattcggaagacgacgaggacgaagggcgtcaggattctacgcttacggcgctgcttaagaagcaagcaaagctgacggagagacgaaacgccaccagagagaataacaaacaaggcgataatgacgacgatgaactctcaggaaggccaggcaaggggaagccggcgctgatatggttcagctcgccgttgcttccagaaaacacgtatttcggcatctaccgagcgatatttacagatgaagagcaacgccagcccgacttggtcgaggtcatccggaagaagcagctcgagcccatagccatgcctaagcctgcaaaagacgggacgctgccgccgatcgcgtacaaggggccgcacttcttcctctgcatgatcggaggcggccattttgccgccatggtcgtctccctcgcgccgagagccgccaaatcgggcagcacaaccatgaaccgagaggccacggtcctcgcccacaagacctttcacagatacacgacgcgtcgaaaacagggtggttctcagtcggcgaacgacaacgccaaaggcaaagcgcactctgtcggctcgtctctgcgtcggtacaacgaaaccgccctggtcgaggatgtgcgcgctcttctccaggactggaaggggctcttggactcttccgaactgcttttcatcagggcaacaggaacgacaaataggagaaccctgttcggcccctatgaaggacaagttcttcaagccaacgacgctcgtatccgagggtttccatttagtaccaggagagctactcagaacgagctgatgcggtccttcatcgagctaactcgactcaaagtcagggagattgctccaagcaaggcaggactagacaaggcgaacgcggcaccaagcaaacctgcgacaccatccaagccggcaaagccgacgttgtcagaagaggaggaaacggcgctgcttcatacgtctcagctacaagcctttgtacggcggtccaagctacctgcacttttatcgtacctcacaaaaaataacctggatccggactttgagttctatcctccggaacaaaactaccatacaccacgccttttacactacgcagctgctcagaactctgctcctttggtgctggggatccttacacgagccggggcgaacccgttgctcaagaacgcggagggaaagacgcccttcgagctcgctggagatcgctctacgcgggatgcctttagagtagcccgctctgaagtaggagaggggaaatgggactgggatgcggccaaggttcctcccgccatgaccaaggacgaggcagatcgccgtgacgagcgggaaaagcaagaagcagataagaaggagtccgacaggagaaaagcggaagaagagaggctccgtactgaagggccaaggctccctgagcagaagacgaagaagggaaacagcatagcgtccataatcgccaagacgccacaagagcgcagggaggaggaagccagggggctgacgcccgagatgaagttgaaactggaacgagaaagacgagcgcgagcggcagaagagagaatcaagaggctacagggtggtagttgaatatatgcttcctgtgagacagctaagccacgtagtagacgtaggtaggtaggtaggtagctcatgctggcatcaatatcgatctatctgaccttgaaatcacctttggctaggttgccagccgttcacttatgattcctaggacgaaatacccatcaagcaactgaacaacacagcagttgtatctattcagaacctttcttgccgtagcaccacacgtgaaatgctcagcgcgtgtcctcgactggcctacaacagaggaggcactcccaagatatgcgtacatagtccacgtctagcccgagttgaaatcaaacatatgccatacaggccttcgtgcatcttttggatgaacaccaacagcatcaccatcatgcacaacgccctggtagggcataaaagggggggaatatgcccaagtgctctttcttcttcttgaatgcgaaagttcttcacgagaacacggaagtctcatccagcacgcggatgcaccaagcatcttcgcttaagacgctcccatgaacgggtggcagtcacgacgggcaagtggtccgatgccgaagagtggcagctgcaagagcgcctgaaccactgccgagggtttccactcccacactcccacactcccacaaattgctctcctggaaacgacatgttctcccacaaacatttcttccttcacgatacccaacatttctctcattccagcctacacttcgatctagacggctttgatttccttcaggtcatacgaggcttgtgcaatggtctccgcatggatcgctgctgttctcctatcaaactcggattttgtcttaggggatggcgtaggaaagacgctgccgcggttcagaagcacctcgatgctatcaggatgtgacaaaaacgactcgaaaacccggattcatcggtgatgctttcgggatcgcaagcgtaaagaaagactctcttccaagacctagaagtatagcaaaatcagcagcagaccatcaatgtatagcgaatgcgcccatacaaaagctgaacgtccccggagaagcacttgtccagggacgggaaataggcttccggaacgggagccattggcagcacagctatatcattctaagtaaacaaatgtaatgagcaagcggacggagtgctgaaacctccgtatgcctgaagccgacgaaagcgcgttggattagaggtcgacagaagatgatattgaaggagcactttttgggcttggctggagctagtggaggtcaacaatgaatgcctattttggtttagtcgtccaggcggtgagcacaaaatttgtgtcgtttgacaagatggttcatttaggcaactggtcagatcagccccacttgtagcagtagcggcggcgctcgaagtgtgactcttattagcagacaggaacgaggacattattatcatctgctgcttggtgcacgataacttggtgcgtttgtcaagcaaggtaagtgaacgacccggtcataccttcttaagttcgcccttcctccctttatttcagattcaatctgacttacctattctacccaagcatcgatatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccacttaacgttactgaaatcatcaaacagcttgacgaatctggatataagatcgttggtgtcgatgtcagctccggagttgagacaaatggtgttcaggatctcgataagatacgttcatttgtccaagcagcaaagagtgccttctagtgatttaatagctccatgtcaacaagaataaaacgcgtttcgggtttacctcttccagatacagctcatctgcaatgcattaatgcattggacctcgcaaccctagtacgcccttcaggctccggcgaagcagaagaatagcttagcagagtctattttcattttcgggagacgagatcaagcagatcaacggtcgtcaagagacctacgagactgaggaatccgctcttggctccacgcgactatatatttgtctctaattgtactttgacatgctcctcttctttactctgatagcttgactatgaaaattccgtcaccagcccctgggttcgcaaagataattgcactgtttcttccttgaactctcaagcctacaggacacacattcatcgtaggtataaacctcgaaaatcattcctactaagatgggtatacaatagtaaccatggttgcctagtgaatgctccgtaacacccaatacgccggccgaaacttttttacaactctcctatgagtcgtttacccagaatgcacaggtacacttgtttagaggtaatccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 216 - DNA, 6705 bp, Artificial sequence
  Corrected mating gene 67350 with promoter and terminator; Transcription initiation factor TFIID, subunit BDF1 and related bromodomain proteins
  CDS (919)..(1002)
  CDS (1138)..(1243)
  CDS (1322)..(1448)
  CDS (1599)..(1835)
  CDS (1926)..(5130)
  CDS (5281)..(6036)
taaaacgacggccagtgaattcaataaagacggcctggaaacggagcggcttgagcagctctctttgttcccaactgcgtgaccaaccagcccgcatcccgcatcccacatccagcccaaacctctcctgcatccgcctgcatcacccattacgcctgatcctccaaacaggagcatcccctaggcggtacgaacaagcgccgagctaatcagatcagcccctcccctaacgctctgcagcacatcacagaaacccgttgtccaagcttgcccttacatgcaaaaccgtgacgctgccctcttccgttaggctgctcagccttcttccctttttcaacctcatctcgttgctgtagcctgtcacgaccaagttcctgcatctctgggaacatcctccacggcatatcacagcttacatcccgcccggcaatcgaccctcttcgacgctcccgcctccacgataccaacaacctccaccatccccgtcgacggcccgaacggaaccggtcacctggtggattgcagcgctgagccttgtgtccgggagtgggcagtagcagggtttcatgtcatgatcgatacctgaagagcgccgcagcttgccgccaccttgtggactcatccctcgacaagcgttctcggaagaggtctgaccttggcttggcgacaggattgtgacaccaaagccggtactgtctcacgagcttggaggggcggaacagtgccctctgagctggctcgaggaggaggccgtctagaccggccaatataagcttggacccgacagagtcggccgtcgaaacacatcgagagtaaaccgcagacatgtcttccacatcgcatatccagactgtctccaatcggtccggcaagtcgtcgaccgctcggggccgcccagcgccgcccgagttcgcacagatgccgtccgccgcggacctcaaatacttcatcccgtctgctgccacggcgtccatcttcctctatgcgcagggaccaacgatagtctgttgccatcacgacacgctcaccatcgaccggaggttctcacgccatgtcgacgatgtccagctgcttgccgtggataaccagagcgacatgggcgctggccggttcgtcgtgagctatgacgctggccagactgccattgtgtgggatctaatgacgggcgatgagatttcgcgtttcgtttcgtacgagacgctcacagtcgccgcttggatgcggaatggaaacgttgctttcggtgagcggaaccagagatcgccctccccctctccccttaagctggtgacatgaggtggctaacggattgggcttccaggcaacacacagggaaacatcatcatgtttgaacctactacatccgagcatatctcggctcggacgctagaccagattgcagtgacagcattagccccttcgtctgactgccggacctttgcgatcgggtaagttggtgttcgaccatgaatcgagaagtctgtcgcgaatgtgccacggcgtactgattccatccgatgtagctaccagaacggatctctcttggtcgcaactctgcagcctcggttcaccatcttacacaacctgacgacctcgagagggccatcgcccattgtcaccctcgcctggcacgcgtcctcctcgaggcagaaatcagacatgctggccgtacagacgcacgatggcgacctgcgggtctggagtgtggccaagtcgtacagcgccgaagatcccgccaaggtcgtcagggtgctccgcaggaacgagaacttcctggctgggcccaattggatggggtggtccaagaacggccgcatcatccaatactcggactcgtaagtcccctatcaactggacacagcctaagcgcgcggcctcccgcttctgctggtttggttttttgttgtgctgacctcgttgtgcagggaaacgttttcgtgggacgtgagaaccaaacatgtcacaaaggactccatcccgacccttgagcatgttaaaggcctggccgtctatggcccaggagccagtctcttcacccttggaccgaacaacaccgtgcagcagtttgacctcaactccccagccatcatggtggcaaacgtgcagcaccccgcgggcgtccttccgccatctccacccacctccgaggagacagggggcaggtcggtgcactctgccacgaccattcatacctcggaatccgagtcgagctctgtccccctcgagatgggcatctctgaaagcgatgacgaccacctatcccctttccagcggctagcaaagcgcaatgcccccgaagccaggaacgaggtgtacgatacaggcagcgcggcctctagccagagcggcgtgtcatccttgtcaaagtcttcggccagctctcgtacgcctggcaggcaggccagctcgctcaggtcgcggggaatgacggaggggacatacatctccgctggttcatccatgaaaacttcgacagttggccagcgcgaggcggacaactactccatgggatacacactccctagcaccagcggtccatcattggcgtcgtcccggtccaggcatcggccctctcgtctcagacacgaagtaccgaggagtcctgacgaggccaacgtgcaggacctgttcaaatacactcgctcgcggcttagcgacctcccgtacaagcacccgatgccaacgcaacgatctcatcctaccaatgacgatttgcgccgacagatgctcagcactatctttggctggaacaaggaagtagaagacctcattcgagacgagatgagtcgctatcccgcagggtcggcgaaccgaatcttgctagccaagtggctgggcgacattgacgcagacatcatggccgcgggttcccagaacatgacttcccaagactggatgctgctggcactgagcggcattggcggccaggcatcccagcacaagctcggccgagtctatgtccaacgcttgctagagaatggcgatgtccatgttgcggtgacgattatgcttgggatgggcgactataacgatgccattgaggtctacatctcgcacaagcggtatatggaggccctcattctcacctgcgtggcttttcccagcgtctgggagcgtcaagctgccattgtgcgcaaatggggtgagtgggcggtcaagcatggccagcagcaactggcaattcgttgctttgcctgtaccgaccaggagtcctcggagccttggacctctccatcggctgcccagctaaacttccaaaacatcaccccgagcatccccgaggtgctgagccctccgctgtcgcccccgggcattcagagaggcccccagcgcagcgtcgccaaggcatcggcactgaagctgattacgtcctttggagatcccacccaaaaggccaagttctactcgcaggctgacggcggccagacaccaattgcagctggagtgacgcccattgccgagtcggccatctctccgggaggcgcctatgatcccgcaactgcgttcctccggccgtcgggcaatagcaggttcaacacgccaacatcagcccgccctatcggtcagggcttcagccgcggacggctgccctccatcggagaagccaacaagcccctggataacattgcaagcattgtggacgcaccccagaaacggccgagccattctcgcaagtcgtccgcccctcaagataacatggcaaccgggctcgccatgcagcgcgctgctacggccagcccaatgatgatgagggaccagtaccagcgcgccgtgcaagggtacggaggagagcgaccgccgtctcccgaccataacatcatgagcagactgcaagaggtccattcggcacagcgaaacggctcccgtgaccggattcctgctcaccttagcctgcagctgcagacgatgcagccgccatcgatggaggcaatgtctcctgagcaatccggcgcctcatccgctcgcttccactggccgtctcgtcgccgcggtactggtcctagttccgcatctgtggccggttccatgacatccacctccagcgctggccggagtcacaaatcgaacgctcgacaaagggatgattacatccatagcctggaagcggctcagcactattccaggagagctggaagccggaccggaagcaaggaacggacacgagacgcgtccaccggccgccacgccagccgagagcgacgaaccaagtcgcgcgacccttcggaagagcgcggcagggcttcagccagatcctggacaaggccaaagcgatcacccacatccccagttccaatgtcccccgaagacttggccatgctgagcaaccggacattcgacaactccgtggaacccctcacgattcgaaaggcgagcgtggcgaaaggcaaggccagcgggcggacatccagccgcggaaggggtggatcagtaccgcggtcaccgccgtccccggtgccgctgtcggcaacagccctgcattatcagggatcggaggacgaggaggactttagagcagccatgcgggcgcaggaagagttcagggccaagcacagccgcagcgtcggccacaacgtcaattctcccgccgtaagccggcgtgagcattcggaaagccgacgaaaggaagcgactgagactcgagaggctgcacccgtggtcttgagccagacagtatatggacgagccgcttccaccgagcacgccggcgatctgaagaagatgaaggacgagagacagcggaagaaggaacaggctgcgcgagagctagaagagcgtaggaagtctctggccaagcgacagctcggtccccagattccccatccaagccagatctctcccgggagaccgccggttctggtagaggccgacgatgaaaagctgccggatgatctgccgccgcgctctgcaacagaacccccgaggacggcggagccgccgaggagcatgtatgctcaaaacaggccgcagattggcctgcctgccactcccaaggcgatgaggctcattatccggtctgacgagaatcagtacgaggacctccctgctccgccggtgccggcgacgttttctcaaaagtattcgccgcagaactcaccccagtactctccgaaatacacgttgggcagtagtgtttatggagaggagcagaagcagcagcagcagcagcagcaacagcagggacagcagcagcagcaacaacgacagcaacaacaacagcagcagcagcaacagcaacagcagcagcagcaacaacaacaactctttcatcagaaagaggaggagccgccgttgacactgctgccatcgactgtctatcagctgccgtccactgtctaccaaccgccgtctcgccccatgattccgcgaagcatgtcggcaccgatccctgatgagccacctcacgcaattcgatacgggagaaagtcgagtgctaacgagggcagaggcctcgacgatattgtagagacggagtggcgtcgacaagtgaacaacctggtgccgcctccaccaccacctcccccttcggcgcccctgactttcctcaaggagctgcagcatctagccgtgccgccccctcctccgccagcaccgctgccacacgtgcgacgccagccgcccgtggctggaacactggcctcgggcatgatcgaaattgtcatggacgatgacgaggcagaagagcccatgtcggctgctcccaacgacggcatggtgccggtgctcgcccagcccgaaccccctgtcaagggccacaaccgcggtcgcagcctcggggagggcagcctttccgggcgtaggaccaaggcgacggagcgcctccgctcgggcagccgcagccgcaaaggatccatcggcgtcatgtcgccccctctcgagatgtacggcggtgagggcaatgccaactcgctgaaccagctcaggtcgcccgtggtgggcaatcctccgcctgtgctgtatgaccgggacgccattcgatcgcccattgaggggcatggccgcaagatgtcgatggggctgcacgagaacggcatgttttaggcttgggtgggcgacttgttgtgtcgcacaaggagttggggcctattcggtattcgctgtcaggctgttcttcgatgcctgtatacgacgcctgcatacgatgcgtttgtcgccatgactttgcttgctttcattggctctgttcttttccgatcgaggaggtttcttccccccccgtgcctggcatctgtgagcatgggacgatatcttgtgtgtccctttggggcaatatttcttttcaattctgatagttggcatggccattcctttgtcttctcttcgttcggtctttcagttctaaagccctccccccttcctttccacttgaggaaagaagaagctgtcttacttcttatccaagtgtgttttagtgagcatgtgcaaaactgggtgctgggatgctttctcttcatttgctttggcaacgtcattatgtccaggggatggttttttcatggaatggcggcttgcaaataccatgcaagctatgtatatcccggcttgaagactcttttctcgctttccttcactgcatctttttttttctctctctcttcgattctttatgactgacgacgggcacctctttttctttttctttttctgggcggaggtataagagaagcaagtaggtggtatgcggaatctagacggctttgatttcct

SEQ ID NO: 217 - protein, 1505 aa, Artificial sequence
  Synthetic Construct
MPSAADLKYFIPSAATASIFLYAQGPTITAIVWDLMTGDEISRFVSYETLTVAAWMRNGNVAFGNTQGNIIMFEPTTSEHISARTLDQIAVTALAPSSDCRTFAIGGPSPIVTLAWHASSSRQKSDMLAVQTHDGDLRVWSVAKSYSAEDPAKVVRVLRRNENFLAGPNWMGWSKNGRIIQYSDSETFSWDVRTKHVTKDSIPTLEHVKGLAVYGPGASLFTLGPNNTVQQFDLNSPAIMVANVQHPAGVLPPSPPTSEETGGRSVHSATTIHTSESESSSVPLEMGISESDDDHLSPFQRLAKRNAPEARNEVYDTGSAASSQSGVSSLSKSSASSRTPGRQASSLRSRGMTEGTYISAGSSMKTSTVGQREADNYSMGYTLPSTSGPSLASSRSRHRPSRLRHEVPRSPDEANVQDLFKYTRSRLSDLPYKHPMPTQRSHPTNDDLRRQMLSTIFGWNKEVEDLIRDEMSRYPAGSANRILLAKWLGDIDADIMAAGSQNMTSQDWMLLALSGIGGQASQHKLGRVYVQRLLENGDVHVAVTIMLGMGDYNDAIEVYISHKRYMEALILTCVAFPSVWERQAAIVRKWGEWAVKHGQQQLAIRCFACTDQESSEPWTSPSAAQLNFQNITPSIPEVLSPPLSPPGIQRGPQRSVAKASALKLITSFGDPTQKAKFYSQADGGQTPIAAGVTPIAESAISPGGAYDPATAFLRPSGNSRFNTPTSARPIGQGFSRGRLPSIGEANKPLDNIASIVDAPQKRPSHSRKSSAPQDNMATGLAMQRAATASPMMMRDQYQRAVQGYGGERPPSPDHNIMSRLQEVHSAQRNGSRDRIPAHLSLQLQTMQPPSMEAMSPEQSGASSARFHWPSRRRGTGPSSASVAGSMTSTSSAGRSHKSNARQRDDYIHSLEAAQHYSRRAGSRTGSKERTRDASTGRHASRERRTKSRDPSEERGRASARSWTRPKRSPTSPVPMSPEDLAMLSNRTFDNSVEPLTIRKASVAKGKASGRTSSRGRGGSVPRSPPSPVPLSATALHYQGSEDEEDFRAAMRAQEEFRAKHSRSVGHNVNSPAVSRREHSESRRKEATETREAAPVVLSQTVYGRAASTEHAGDLKKMKDERQRKKEQAARELEERRKSLAKRQLGPQIPHPSQISPGRPPVLVEADDEKLPDDLPPRSATEPPRTAEPPRSMYAQNRPQIGLPATPKAMRLIIRSDENQYEDLPAPPVPATFSQKYSPQNSPQYSPKYTLGSSEPPLTLLPSTVYQLPSTVYQPPSRPMIPRSMSAPIPDEPPHAIRYGRKSSANEGRGLDDIVETEWRRQVNNLVPPPPPPPPSAPLTFLKELQHLAVPPPPPPAPLPHVRRQPPVAGTLASGMIEIVMDDDEAEEPMSAAPNDGMVPVLAQPEPPVKGHNRGRSLGEGSLSGRRTKATERLRSGSRSRKGSIGVMSPPLEMYGGEGNANSLNQLRSPVVGNPPPVLYDRDAIRSPIEGHGRKMSMGLHENGMF

SEQ ID NO: 218 - DNA, 3436 bp, Artificial sequence
  Corrected mating gene 76887 with promoter and terminator; Aspartyl protease
  CDS (1263)..(1476)
  CDS (1600)..(2723)
taaaacgacggccagtgaattcttctctgatcgttgggctatgaatagtgctgggagcgaatccatcagacatctcactggaatgtttaataccaccagacttggcattgcttttatgcccaatatgaaggctcaaaacttagcagcttgaatcgcttgttaacagacctcatcaaaagatgctccatcagcctttgaaaagttggaggcgggagtcgatccacaaggttcgatgacgacggaggctgtcgaggccttttcccagcgatccgaagactccccacagactccgcatgctctgatgctcagctggctgcttgattgggctgacgctccatgctctccataatctccataccagcaacaagctttttacgcatatcttgaagaatgacagaactttgatactataagcatttataaggtagtagaatagttcttcgtgtaggtaggtagcagtagtactaggcaactctactctgaggcaacctcgtacgtagtagtagtagtgagtagcttgtcgagcctcctccaggccacccgccgcttgatccgcctgaaatagcgtcgcgtagctgatgaaccgagcgccacaaagcggaaagacgagcttggcggctcgaatccaggcggaccggagcaataaagtccagcactagtgggtgtccaagaggagctgcgccgcgttgctccagcttcagctccggccaagctccaaggttcaagaaagttgtcggcaagacgcgactcggaaaggctgtgggcgtctctgctcctatggagcagtgcagccaccaggccagaggggctgcttcaccgataatggctaggggaggaggccagatgaatggaagatgagatcatgaaggaggacgtaaaggctcttcttacaaatagtactacttttaccccggaaaccggacgagctggcaacgtttgctctccttgtcccgtcactttcgacccttgtcgccgtcgtccccgctagcagcaagatcgtgccgagatcttgctctgttgctttggtggtttgccgtgctctgttttcgttgtcgtacgaactcagcctacctacttattctttctcttatcctaatacttcattctgtattactcccgttctcagttcttcatccctttgcttccggtttttgatcaatatactttacagggagaggagaagagaagagaagcggaagggaagtgacaggaagagagagagaggggatagaagaagagtcggcagagctctcagcgcaaccatgaggccgccaacgtcgttgtcagcagctctgacgctgctcctcgcgacggattacattgaagccatcgctactcccgttttcccgagggcgaaatctggggatgggtatttggcgattcccgtgggaaccatcccgaggccgcacaaggtcggcaagagaagcgccatcgatgctacgctacagaacatggactttttctatgccattcaaggtaatgcatcacctttgttaacaccaccagaagcttctgttcagctcgtgtctctatcgtccgcttttaagtgcactatctacggtctgcaaagtgtacatgctaataaatggtcggcaacagtcggcatgggaacgcctccccagaatgtgaccgtcctcgtcgacacgggatccagcgagctatgggtcaatcccgactgctcaaccgcgccgtcccagcaacaggccgacatgtgcgagaatctgggccagtacaaccccaggaaatcaagaacaccgcccgtcggcccgtttgggcgtgaagagatcaactatggcgaccctacggaccagtccacgcagacgtcggtcgacattacctactatgccgacacgctgagctttggcagcatccaggtcaagaaccagacgtttggcgtcgtcacggccagcgacggccaggcgcagggcatcatgggcctcgcacccgacgtccggggcggattcccgggagacgagccgtacagcctgctgctcaacaccatggccgagcagggtgtcattgcaagccgagtctttgcactcgatctccggcactccgactcggagacaggcgccatcatctacggcggcctcgatcgcagcaagtttgtcggctctctcgaagcacgtccgattgtgcgcggcatcaagggcgaaactcggctggccgtcaacctcacgacgctgggcctcaccctgggccggtcccagagcttccggctctctgctgccgacaccaacgtgatgctcgactccggcacgacgctcagccggatgcacgaggctgctgccattcccatcctcgaggccctgggcgcccaagacgccggcgagggctacttctacgtgccgtgctcgacccggaacgctggcggcagtgtagatttcggcttcggcaacaaggttgtccgcgtccccttttccgactttatactgacgggcgaagactcgagcgactcagactattgcttcgttggcatcgtcatcaccaccgaccagcagattctgggcgacacggtgctgcgggccggatactttgtctttgactgggacaaccgggaggttcacattgcccaggccgcggattgcggcagcagtgacattgttgttgctggcagggggtccgatgccgttcccagcgttcaggggaactgcaatgagaacgaagcgtttcccaccggctcaggaagcccaacggtaagcatctcttttgtccaaactgcgtgacaaccgacgactaaccacaagtctcgctgcagatcactgcatccaactccggagccaccaacttgatcccgacctcggccttcacgacgacgtttacggtgacgtcctgcccggtcttcgacatcaactgccgcaccggcgtcgtcacgacgcggacggttcggccagctgaagccactgccgaacctacaagcaccagctctcccagcggctccggcagcggcgacggggatggcggaggtgatgaagacgctggtgtacggcttgtcccttttacctgggtgctcgtggcgctgggcaccctggcaatgtttgtcaacattgtataaattgtccaggaggtcatttctcttggataggtactcagagcttgtttacacgtttcgaagcttttgtatatacgggtgagctggatcggccgacattaatgggcattcgcgattaggtagaggatttatcctaggatcttgaatatgaggcaggggatttgaatagacggacgatgcattgtctttggttttctgcaaaaggcaccagcctggtcaacgcgtaatacccatgacattgatgattgtaggtagtatgtcatgtagaaacgggtctttgtgaagtggaagtatcagtaagccgtatagttggccttttctgtctcacggggtgactgcatgcacctttgtcttgtcgaggcatctagacggctttgatttcct

SEQ ID NO: 219 - protein, 446 aa, Artificial sequence
  Synthetic Construct
MRPPTSLSAALTLLLATDYIEAIATPVFPRAKSGDGYLAIPVGTIPRPHKVGKRSAIDATLQNMDFFYAIQVGMGTPPQNVTVLVDTGSSELWVNPDCSTAPSQQQADMCENLGQYNPRKSRTPPVGPFGREEINYGDPTDQSTQTSVDITYYADTLSFGSIQVKNQTFGVVTASDGQAQGIMGLAPDVRGGFPGDEPYSLLLNTMAEQGVIASRVFALDLRHSDSETGAIIYGGLDRSKFVGSLEARPIVRGIKGETRLAVNLTTLGLTLGRSQSFRLSAADTNVMLDSGTTLSRMHEAAAIPILEALGAQDAGEGYFYVPCSTRNAGGSVDFGFGNKVVRVPFSDFILTGEDSSDSDYCFVGIVITTDQQILGDTVLRAGYFVFDWDNREVHIAQAADCGSSDIVVAGRGSDAVPSVQGNCNENEAFPTGSGSPTVSISFVQTA

SEQ ID NO: 220 - DNA, 3659 bp, Artificial sequence
  Corrected mating gene 105832 with promoter and terminator; Phosphoribosylamidoimidazole-succinocarboxamide synthase
  CDS (888)..(1777)
  CDS (1833)..(2520)
  CDS (2587)..(2787)
taaaacgacggccagtgaattcatgtagagcggcaccaagcagccttcagagttctcaagcctcatgtataaatgctacctcaccaggtgctatggaagcagattgggtgcagcgaatgcctcatcaatccatcaagatacttcaacaggagctcaccaccgaaagccactgatataagctgaaggaaaggcagtctaaacagcgaaaacaaaaacaatgagttggcagcgtaatcttgacgcccagatatctacatctacattacagatgctgtcgacttgactagaagtttggtcaaaacagggtagtcgtggaacggagacgagcgtttgcaattgggcgtatgacgtcattgcgtgagccatcagatagatgttgcatggagcgtaatggttgatcttggttgatcgacagataagataagcacccgcaaattttcgcggggcacttgatgcgcaatatcgatacccgataacgataacactttgatgttattggactctgtacgcactgtttttgctgccaagattggttgttgtctttatttcatacgcgttccgacagaatttgcatacatgcagcgattggaaagagccttcagccttcttcttcgtacctgaccttgtgatgatttgctgcgagtaacttcgtatcttgcgagtcatagacaaggtggtgagggtgaggcggggcatcgtacctggtggggtatcagatctgctaaatgttttcgtgctatcttgttaggacatcaaattcttccgagtgtctcatcgctgcgctttttccacgacttcgccgaactcctgcgaaaatcaccgagccgtcgctcacttgagcaaacgaagccgagtcacacgcttccagctctctctcgacgttcaagatgagcccgaaacccgtcatcggccttttgggaggcggccagctgggccggatgctgtgccaggccgcggctcccctcgatgtcgaaatcgccatcctcgacgccgagaatgcccccgcgaagcaggtcaaccacaacagccgcaacatcaatggctcgtacaaagacgcggagaagatcaaggagctggcctcccactgcagcgtcctcagcgtcgagaccgagcacgtggacacgacggtgctggaagagattgcgacgactacaaaggtggccgtgtgcccgtcatggaagacgattcgactgatccaggacaagtacgagcagaaggcctacctggccagcaagggaattcccgtcgctgagtcggtggctattgagggatctggcgatgccatgctcgcctctctcaaagccgtgtctgccaaattcggctatccctggatgctcaaggccaggaaggactcttacgacggccgagggaacatgaagatctctggcgaagccgacctcgaacatgctgtcgccgagtttggcaagtttggctgctatgctgaaaagtttgtcccgttccaatgcgagctgtctgtcctcgtgattcgcacggaagacgacgacggccagaccaagcgcctgctgccgtatcccgccgtcgagacggtacatgaagacaacatttgctcacgagtctacctgcctcctcggaccactcctgcttctgcctgcgagcaggcacagaaggtcgccagcgacgtcgtcgacaagctttggggaagaggcatcttcgctgttgagatgtttgtcacccaggacaaccagatccttgtcaacgagattgccccgcgaccgcacaactctggccatctgttcattgaagcggttccatacatgtacgtattcacccgttgccctgctggttactgctctaacaaggctgtatattaggtcacagtacaaggcacagctcacctcgatcctcgaccagactctcccgcccaaaattgagccgtacgttgcttcgagtatcatgatcaacattctcggaggcgccaatcccgactcccatctcccgcttgtcgagaaagccaagtccatgtacggagacaagatggctgtttacgtccacctttatggcaaagagtccaagcccagccgaaagattggacacatcacagttactggcttagtcgccagcatagcggagctcgaagagtttgcgaaaccgctggtggacatggccagcgacatcagacaggagaggctacaatcgcgcaccaaggcattgcggccagaccaggcggtttccaagcccgctcaggcgccgctggtccttgttacaatgggctcggactcagaccttcctgtgcttaaggctggcatcgacatcctgaaccagtttggcgtgccctgggaagttgacatcacatcggcgcatcgcacgccggccaagatggctgatgtcgccacgaaagccgctgctcgcggcatcaaggtcatcatcgccgcagctggaggagcagctcatttgcctggaatggtgtcggcctacacgccgctccccgtcattggcgttcccgtcaaggccacgcacctcgatggtgtcgattctctctattcgattgttcagatgccggtaagtacatacaacctttttggcttcctttccccttccttgtacgtgaggctgacgagcgtatagcgcggtgtaccgacagccacggttggcatcaacaactcgaccaatgcagccctcctcgcaatcagatgcctaggtgcctttattcccgaatacctcgagaaaatgaaggcgtatcagctggacaacgagaagcaagtggaagagaaggcgaaccgactgcgagagatgaacgtcgaggcctaccttgcgcaaatgaagaaatgagggagtcttaatttgacgctgcgagccagctggcccaacctcgatatcctaggctgaccgtgaaggacgatcatgcaccaaaaccagttcctgcgtgcataacttagaatcgcattcggaggctttgcggatcgaaccatcgactcccagcaattgtatgctttggccgctgacaccacgcctcaacatgcaacattcgttgtggcattatttcgaatcacgaatatctacagtgtcttatatatatctcaactttggaaaagaatcaacccacttaatgcctcacgaggcttctcattagatagggcggtggcaaatctgtaaagcaggcgagatcacgcaaccaagacatgatccggtgtcctttccctgtggttgatgagtatccaatcgtgagcatatggcagcgagctgtgctctccaggcgcccgagtggaaggcatgcctctactcttatataggccaatccaaagtttttgagcaacaagacttttggcgtataacactagcagttgaacgccccggggataggagtcttcgcactgaccactcgacaactagagtagtcaatcggctgactatcccccgtcctgatcatgtgaatctactatcccactcttcttggccctcaggagtccctctgaagggctctctgggggacctcagagactccatttgtttgtgtgactgtccgcgaagctatgggctacaaggcagaccatcatgctcgcctgcgccgttgtcaaaacctcgtccttgctcgagcagcctgttaatggcctcttcgccaccggattgattgtggcaactggaagggcctcagattgtgaacgaaagccacgcgattgtctagacggctttgatttcct

SEQ ID NO: 221 - protein, 593 aa, Artificial sequence
  Synthetic Construct
MSPKPVIGLLGGGQLGRMLCQAAAPLDVEIAILDAENAPAKQVNHNSRNINGSYKDAEKIKELASHCSVLSVETEHVDTTVLEEIATTTKVAVCPSWKTIRLIQDKYEQKAYLASKGIPVAESVAIEGSGDAMLASLKAVSAKFGYPWMLKARKDSYDGRGNMKISGEADLEHAVAEFGKFGCYAEKFVPFQCELSVLVIRTEDDDGQTKRLLPYPAVETVHEDNICSRVYLPPRTTPASACEQAQKVASDVVDKLWGRGIFAVEMFVTQDNQILVNEIAPRPHNSGHLFIEAVPYMSQYKAQLTSILDQTLPPKIEPYVASSIMINILGGANPDSHLPLVEKAKSMYGDKMAVYVHLYGKESKPSRKIGHITVTGLVASIAELEEFAKPLVDMASDIRQERLQSRTKALRPDQAVSKPAQAPLVLVTMGSDSDLPVLKAGIDILNQFGVPWEVDITSAHRTPAKMADVATKAAARGIKVIIAAAGGAAHLPGMVSAYTPLPVIGVPVKATHLDGVDSLYSIVQMPRGVPTATVGINNSTNAALLAIRCLGAFIPEYLEKMKAYQLDNEKQVEEKANRLREMNVEAYLAQMKK

SEQ ID NO: 222 - DNA, 3848 bp, Artificial sequence
  Corrected mating gene 59270 with promoter and terminator; Ankyrin repeat protein
  CDS (990)..(1035)
  CDS (1204)..(3104)
taaaacgacggccagtgaattccgccaggttgatcttgttctacagaggccagcgactcagcataattgcttgttcgagcggattagacagatcagtgcagccctcgtcaggcacaaggcacgagtcgaagatatgccccaacccgcagctccagcgcccgtacccaagtcttgttgcctttgtgccacattctgtacccagctgcctaagacgtagcattggacatgtgatgcagatgtatttgtagggggtatcgggaagtgcccgtgtgcttcgcgatgagattccgcagatttacaccctgaaccgctaccctacaataccttacatcttacaagtctacaagggtaaaatacgtcggcatgtgcgagtaccaaaccacaatatgccaacttccgctatctactcacctttgatatattccccacgtacaattattctgccttttcgttgggttaccgctactggtcctcggctgatacatgaaggcggattatcatcctggtgttgtggatcagctgcaatcgaatgggctctacgcaatcatatgaggaaacatcagcataaacaataatatgctaaacgtcagattagagaaaagcaatgagtagaatgacaacctgacgagagttcacgttgtgaacaagcctcgaggctgttcaaggctcggacccaacagggaatacttactactaggtatggagatcaagcctcgtaaagccgggttatgactctgttcagcaccttatcttagtggggtggtcgccggttgactcaacatcattccagcctcgtcatagaggggcaactcttcagccttttctaccaccgcaactcccctcttgctcgcgacaaataccttggtcgcacagctctttgctgttcacgcgtctttcttttgcttcgacagtttaaatacagaagccgccttgcttgccgtaggattcaacgacgctccatacccgcagcctccccgggacttgacacaatggctcagaacccggcagacgagctccttcggcgtccgttatatggtaagtaaaagcactttgtcgcgccactggcaaggcctaccaataccggccgagacacgggacacgagacatacagcttataggacacgcgctgtttcttgcccgagtctcgattcgattctacgatctctgaacaagtgctgacaacttgcgccaacgcggtcttagtctacgatcttccaccagaaagcctcgcaggcttgacgctgaaaccggacgcagacgccatcgccatcgaggaacccgagacgtcaacgactcccagccaggcttcggactcgtcctccgacagctttgtcggttcccaagcatgctctctctgcaagctttccttcaccaccgtaatagaccagcgaagtcacatcaagtccgatttccacaactacaatctcaagcagaagctgcggggtcagggcccggtctcagagaccgagttcgaaaagctgattgagactctggacgaatcgctctcgggctccgactcggaagattcggaagacgacgaggacgaagggcgtcaggattctacgcttacggcgctgcttaagaagcaagcaaagctgacggagagacgaaacgccaccagagagaataacaaacaaggcgataatgacgacgatgaactctcaggaaggccaggcaaggggaagccggcgctgatatggttcagctcgccgttgcttccagaaaacacgtatttcggcatctaccgagcgatatttacagatgaagagcaacgccagcccgacttggtcgaggtcatccggaagaagcagctcgagcccatagccatgcctaagcctgcaaaagacgggacgctgccgccgatcgcgtacaaggggccgcacttcttcctctgcatgatcggaggcggccattttgccgccatggtcgtctccctcgcgccgagagccgccaaatcgggcagcacaaccatgaaccgagaggccacggtcctcgcccacaagacctttcacagatacacgacgcgtcgaaaacagggtggttctcagtcggcgaacgacaacgccaaaggcaaagcgcactctgtcggctcgtctctgcgtcggtacaacgaaaccgccctggtcgaggatgtgcgcgctcttctccaggactggaaggggctcttggactcttccgaactgcttttcatcagggcaacaggaacgacaaataggagaaccctgttcggcccctatgaaggacaagttcttcaagccaacgacgctcgtatccgagggtttccatttagtaccaggagagctactcagaacgagctgatgcggtccttcatcgagctaactcgactcaaagtcagggagattgctccaagcaaggcaggactagacaaggcgaacgcggcaccaagcaaacctgcgacaccatccaagccggcaaagccgacgttgtcagaagaggaggaaacggcgctgcttcatacgtctcagctacaagcctttgtacggcggtccaagctacctgcacttttatcgtacctcacaaaaaataacctggatccggactttgagttctatcctccggaacaaaactaccatacaccacgccttttacactacgcagctgctcagaactctgctcctttggtgctggggatccttacacgagccggggcgaacccgttgctcaagaacgcggagggaaagacgcccttcgagctcgctggagatcgctctacgcgggatgcctttagagtagcccgctctgaagtaggagaggggaaatgggactgggatgcggccaaggttcctcccgccatgaccaaggacgaggcagatcgccgtgacgagcgggaaaagcaagaagcagataagaaggagtccgacaggagaaaagcggaagaagagaggctccgtactgaagggccaaggctccctgagcagaagacgaagaagggaaacagcatagcgtccataatcgccaagacgccacaagagcgcagggaggaggaagccagggggctgacgcccgagatgaagttgaaactggaacgagaaagacgagcgcgagcggcagaagagagaatcaagaggctacagggtggtagttgaatatatgcttcctgtgagacagctaagccacgtagtagacgtaggtaggtaggtaggtagctcatgctggcatcaatatcgatctatctgaccttgaaatcacctttggctaggttgccagccgttcacttatgattcctaggacgaaatacccatcaagcaactgaacaacacagcagttgtatctattcagaacctttcttgccgtagcaccacacgtgaaatgctcagcgcgtgtcctcgactggcctacaacagaggaggcactcccaagatatgcgtacatagtccacgtctagcccgagttgaaatcaaacatatgccatacaggccttcgtgcatcttttggatgaacaccaacagcatcaccatcatgcacaacgccctggtagggcataaaagggggggaatatgcccaagtgctctttcttcttcttgaatgcgaaagttcttcacgagaacacggaagtctcatccagcacgcggatgcaccaagcatcttcgcttaagacgctcccatgaacgggtggcagtcacgacgggcaagtggtccgatgccgaagagtggcagctgcaagagcgcctgaaccactgccgagggtttccactcccacactcccacactcccacaaattgctctcctggaaacgacatgttctcccacaaacatttcttccttcacgatacccaacatttctctcattccagcctacacttcgatctagacggctttgatttcct

SEQ ID NO: 223 - protein, 649 aa, Artificial sequence
  Synthetic Construct
MAQNPADELLRRPLYVYDLPPESLAGLTLKPDADAIAIEEPETSTTPSQASDSSSDSFVGSQACSLCKLSFTTVIDQRSHIKSDFHNYNLKQKLRGQGPVSETEFEKLIETLDESLSGSDSEDSEDDEDEGRQDSTLTALLKKQAKLTERRNATRENNKQGDNDDDELSGRPGKGKPALIWFSSPLLPENTYFGIYRAIFTDEEQRQPDLVEVIRKKQLEPIAMPKPAKDGTLPPIAYKGPHFFLCMIGGGHFAAMVVSLAPRAAKSGSTTMNREATVLAHKTFHRYTTRRKQGGSQSANDNAKGKAHSVGSSLRRYNETALVEDVRALLQDWKGLLDSSELLFIRATGTTNRRTLFGPYEGQVLQANDARIRGFPFSTRRATQNELMRSFIELTRLKVREIAPSKAGLDKANAAPSKPATPSKPAKPTLSEEEETALLHTSQLQAFVRRSKLPALLSYLTKNNLDPDFEFYPPEQNYHTPRLLHYAAAQNSAPLVLGILTRAGANPLLKNAEGKTPFELAGDRSTRDAFRVARSEVGEGKWDWDAAKVPPAMTKDEADRRDEREKQEADKKESDRRKAEEERLRTEGPRLPEQKTKKGNSIASIIAKTPQERREEEARGLTPEMKLKLERERRARAAEERIKRLQGGS

SEQ ID NO: 224 - DNA, 3659 bp, Artificial sequence
  functional variant (c.948C>A; p.Gln21Lys) of corrected mating gene 105832; Phosphoribosylamidoimidazole-succinocarboxamide synthase
  CDS (888)..(1777)
  CDS (1833)..(2520)
  CDS (2587)..(2787)
taaaacgacggccagtgaattcatgtagagcggcaccaagcagccttcagagttctcaagcctcatgtataaatgctacctcaccaggtgctatggaagcagattgggtgcagcgaatgcctcatcaatccatcaagatacttcaacaggagctcaccaccgaaagccactgatataagctgaaggaaaggcagtctaaacagcgaaaacaaaaacaatgagttggcagcgtaatcttgacgcccagatatctacatctacattacagatgctgtcgacttgactagaagtttggtcaaaacagggtagtcgtggaacggagacgagcgtttgcaattgggcgtatgacgtcattgcgtgagccatcagatagatgttgcatggagcgtaatggttgatcttggttgatcgacagataagataagcacccgcaaattttcgcggggcacttgatgcgcaatatcgatacccgataacgataacactttgatgttattggactctgtacgcactgtttttgctgccaagattggttgttgtctttatttcatacgcgttccgacagaatttgcatacatgcagcgattggaaagagccttcagccttcttcttcgtacctgaccttgtgatgatttgctgcgagtaacttcgtatcttgcgagtcatagacaaggtggtgagggtgaggcggggcatcgtacctggtggggtatcagatctgctaaatgttttcgtgctatcttgttaggacatcaaattcttccgagtgtctcatcgctgcgctttttccacgacttcgccgaactcctgcgaaaatcaccgagccgtcgctcacttgagcaaacgaagccgagtcacacgcttccagctctctctcgacgttcaagatgagcccgaaacccgtcatcggccttttgggaggcggccagctgggccggatgctgtgcaaggccgcggctcccctcgatgtcgaaatcgccatcctcgacgccgagaatgcccccgcgaagcaggtcaaccacaacagccgcaacatcaatggctcgtacaaagacgcggagaagatcaaggagctggcctcccactgcagcgtcctcagcgtcgagaccgagcacgtggacacgacggtgctggaagagattgcgacgactacaaaggtggccgtgtgcccgtcatggaagacgattcgactgatccaggacaagtacgagcagaaggcctacctggccagcaagggaattcccgtcgctgagtcggtggctattgagggatctggcgatgccatgctcgcctctctcaaagccgtgtctgccaaattcggctatccctggatgctcaaggccaggaaggactcttacgacggccgagggaacatgaagatctctggcgaagccgacctcgaacatgctgtcgccgagtttggcaagtttggctgctatgctgaaaagtttgtcccgttccaatgcgagctgtctgtcctcgtgattcgcacggaagacgacgacggccagaccaagcgcctgctgccgtatcccgccgtcgagacggtacatgaagacaacatttgctcacgagtctacctgcctcctcggaccactcctgcttctgcctgcgagcaggcacagaaggtcgccagcgacgtcgtcgacaagctttggggaagaggcatcttcgctgttgagatgtttgtcacccaggacaaccagatccttgtcaacgagattgccccgcgaccgcacaactctggccatctgttcattgaagcggttccatacatgtacgtattcacccgttgccctgctggttactgctctaacaaggctgtatattaggtcacagtacaaggcacagctcacctcgatcctcgaccagactctcccgcccaaaattgagccgtacgttgcttcgagtatcatgatcaacattctcggaggcgccaatcccgactcccatctcccgcttgtcgagaaagccaagtccatgtacggagacaagatggctgtttacgtccacctttatggcaaagagtccaagcccagccgaaagattggacacatcacagttactggcttagtcgccagcatagcggagctcgaagagtttgcgaaaccgctggtggacatggccagcgacatcagacaggagaggctacaatcgcgcaccaaggcattgcggccagaccaggcggtttccaagcccgctcaggcgccgctggtccttgttacaatgggctcggactcagaccttcctgtgcttaaggctggcatcgacatcctgaaccagtttggcgtgccctgggaagttgacatcacatcggcgcatcgcacgccggccaagatggctgatgtcgccacgaaagccgctgctcgcggcatcaaggtcatcatcgccgcagctggaggagcagctcatttgcctggaatggtgtcggcctacacgccgctccccgtcattggcgttcccgtcaaggccacgcacctcgatggtgtcgattctctctattcgattgttcagatgccggtaagtacatacaacctttttggcttcctttccccttccttgtacgtgaggctgacgagcgtatagcgcggtgtaccgacagccacggttggcatcaacaactcgaccaatgcagccctcctcgcaatcagatgcctaggtgcctttattcccgaatacctcgagaaaatgaaggcgtatcagctggacaacgagaagcaagtggaagagaaggcgaaccgactgcgagagatgaacgtcgaggcctaccttgcgcaaatgaagaaatgagggagtcttaatttgacgctgcgagccagctggcccaacctcgatatcctaggctgaccgtgaaggacgatcatgcaccaaaaccagttcctgcgtgcataacttagaatcgcattcggaggctttgcggatcgaaccatcgactcccagcaattgtatgctttggccgctgacaccacgcctcaacatgcaacattcgttgtggcattatttcgaatcacgaatatctacagtgtcttatatatatctcaactttggaaaagaatcaacccacttaatgcctcacgaggcttctcattagatagggcggtggcaaatctgtaaagcaggcgagatcacgcaaccaagacatgatccggtgtcctttccctgtggttgatgagtatccaatcgtgagcatatggcagcgagctgtgctctccaggcgcccgagtggaaggcatgcctctactcttatataggccaatccaaagtttttgagcaacaagacttttggcgtataacactagcagttgaacgccccggggataggagtcttcgcactgaccactcgacaactagagtagtcaatcggctgactatcccccgtcctgatcatgtgaatctactatcccactcttcttggccctcaggagtccctctgaagggctctctgggggacctcagagactccatttgtttgtgtgactgtccgcgaagctatgggctacaaggcagaccatcatgctcgcctgcgccgttgtcaaaacctcgtccttgctcgagcagcctgttaatggcctcttcgccaccggattgattgtggcaactggaagggcctcagattgtgaacgaaagccacgcgattgtctagacggctttgatttcct

SEQ ID NO: 225 - protein, 593 aa, Artificial sequence
  Synthetic Construct
MSPKPVIGLLGGGQLGRMLCKAAAPLDVEIAILDAENAPAKQVNHNSRNINGSYKDAEKIKELASHCSVLSVETEHVDTTVLEEIATTTKVAVCPSWKTIRLIQDKYEQKAYLASKGIPVAESVAIEGSGDAMLASLKAVSAKFGYPWMLKARKDSYDGRGNMKISGEADLEHAVAEFGKFGCYAEKFVPFQCELSVLVIRTEDDDGQTKRLLPYPAVETVHEDNICSRVYLPPRTTPASACEQAQKVASDVVDKLWGRGIFAVEMFVTQDNQILVNEIAPRPHNSGHLFIEAVPYMSQYKAQLTSILDQTLPPKIEPYVASSIMINILGGANPDSHLPLVEKAKSMYGDKMAVYVHLYGKESKPSRKIGHITVTGLVASIAELEEFAKPLVDMASDIRQERLQSRTKALRPDQAVSKPAQAPLVLVTMGSDSDLPVLKAGIDILNQFGVPWEVDITSAHRTPAKMADVATKAAARGIKVIIAAAGGAAHLPGMVSAYTPLPVIGVPVKATHLDGVDSLYSIVQMPRGVPTATVGINNSTNAALLAIRCLGAFIPEYLEKMKAYQLDNEKQVEEKANRLREMNVEAYLAQMKK

SEQ ID NO: 226 - DNA, 6705 bp, Artificial sequence
  functional variant (c.4227A>C; p.Glu952Asp) of corrected mating gene 67350; Transcription initiation factor TFIID, subunit BDF1 and related bromodomain proteins
  CDS (919)..(1002)
  CDS (1138)..(1243)
  CDS (1322)..(1448)
  CDS (1599)..(1835)
  CDS (1926)..(5130)
  CDS (5281)..(6036)
taaaacgacggccagtgaattcaataaagacggcctggaaacggagcggcttgagcagctctctttgttcccaactgcgtgaccaaccagcccgcatcccgcatcccacatccagcccaaacctctcctgcatccgcctgcatcacccattacgcctgatcctccaaacaggagcatcccctaggcggtacgaacaagcgccgagctaatcagatcagcccctcccctaacgctctgcagcacatcacagaaacccgttgtccaagcttgcccttacatgcaaaaccgtgacgctgccctcttccgttaggctgctcagccttcttccctttttcaacctcatctcgttgctgtagcctgtcacgaccaagttcctgcatctctgggaacatcctccacggcatatcacagcttacatcccgcccggcaatcgaccctcttcgacgctcccgcctccacgataccaacaacctccaccatccccgtcgacggcccgaacggaaccggtcacctggtggattgcagcgctgagccttgtgtccgggagtgggcagtagcagggtttcatgtcatgatcgatacctgaagagcgccgcagcttgccgccaccttgtggactcatccctcgacaagcgttctcggaagaggtctgaccttggcttggcgacaggattgtgacaccaaagccggtactgtctcacgagcttggaggggcggaacagtgccctctgagctggctcgaggaggaggccgtctagaccggccaatataagcttggacccgacagagtcggccgtcgaaacacatcgagagtaaaccgcagacatgtcttccacatcgcatatccagactgtctccaatcggtccggcaagtcgtcgaccgctcggggccgcccagcgccgcccgagttcgcacagatgccgtccgccgcggacctcaaatacttcatcccgtctgctgccacggcgtccatcttcctctatgcgcagggaccaacgatagtctgttgccatcacgacacgctcaccatcgaccggaggttctcacgccatgtcgacgatgtccagctgcttgccgtggataaccagagcgacatgggcgctggccggttcgtcgtgagctatgacgctggccagactgccattgtgtgggatctaatgacgggcgatgagatttcgcgtttcgtttcgtacgagacgctcacagtcgccgcttggatgcggaatggaaacgttgctttcggtgagcggaaccagagatcgccctccccctctccccttaagctggtgacatgaggtggctaacggattgggcttccaggcaacacacagggaaacatcatcatgtttgaacctactacatccgagcatatctcggctcggacgctagaccagattgcagtgacagcattagccccttcgtctgactgccggacctttgcgatcgggtaagttggtgttcgaccatgaatcgagaagtctgtcgcgaatgtgccacggcgtactgattccatccgatgtagctaccagaacggatctctcttggtcgcaactctgcagcctcggttcaccatcttacacaacctgacgacctcgagagggccatcgcccattgtcaccctcgcctggcacgcgtcctcctcgaggcagaaatcagacatgctggccgtacagacgcacgatggcgacctgcgggtctggagtgtggccaagtcgtacagcgccgaagatcccgccaaggtcgtcagggtgctccgcaggaacgagaacttcctggctgggcccaattggatggggtggtccaagaacggccgcatcatccaatactcggactcgtaagtcccctatcaactggacacagcctaagcgcgcggcctcccgcttctgctggtttggttttttgttgtgctgacctcgttgtgcagggaaacgttttcgtgggacgtgagaaccaaacatgtcacaaaggactccatcccgacccttgagcatgttaaaggcctggccgtctatggcccaggagccagtctcttcacccttggaccgaacaacaccgtgcagcagtttgacctcaactccccagccatcatggtggcaaacgtgcagcaccccgcgggcgtccttccgccatctccacccacctccgaggagacagggggcaggtcggtgcactctgccacgaccattcatacctcggaatccgagtcgagctctgtccccctcgagatgggcatctctgaaagcgatgacgaccacctatcccctttccagcggctagcaaagcgcaatgcccccgaagccaggaacgaggtgtacgatacaggcagcgcggcctctagccagagcggcgtgtcatccttgtcaaagtcttcggccagctctcgtacgcctggcaggcaggccagctcgctcaggtcgcggggaatgacggaggggacatacatctccgctggttcatccatgaaaacttcgacagttggccagcgcgaggcggacaactactccatgggatacacactccctagcaccagcggtccatcattggcgtcgtcccggtccaggcatcggccctctcgtctcagacacgaagtaccgaggagtcctgacgaggccaacgtgcaggacctgttcaaatacactcgctcgcggcttagcgacctcccgtacaagcacccgatgccaacgcaacgatctcatcctaccaatgacgatttgcgccgacagatgctcagcactatctttggctggaacaaggaagtagaagacctcattcgagacgagatgagtcgctatcccgcagggtcggcgaaccgaatcttgctagccaagtggctgggcgacattgacgcagacatcatggccgcgggttcccagaacatgacttcccaagactggatgctgctggcactgagcggcattggcggccaggcatcccagcacaagctcggccgagtctatgtccaacgcttgctagagaatggcgatgtccatgttgcggtgacgattatgcttgggatgggcgactataacgatgccattgaggtctacatctcgcacaagcggtatatggaggccctcattctcacctgcgtggcttttcccagcgtctgggagcgtcaagctgccattgtgcgcaaatggggtgagtgggcggtcaagcatggccagcagcaactggcaattcgttgctttgcctgtaccgaccaggagtcctcggagccttggacctctccatcggctgcccagctaaacttccaaaacatcaccccgagcatccccgaggtgctgagccctccgctgtcgcccccgggcattcagagaggcccccagcgcagcgtcgccaaggcatcggcactgaagctgattacgtcctttggagatcccacccaaaaggccaagttctactcgcaggctgacggcggccagacaccaattgcagctggagtgacgcccattgccgagtcggccatctctccgggaggcgcctatgatcccgcaactgcgttcctccggccgtcgggcaatagcaggttcaacacgccaacatcagcccgccctatcggtcagggcttcagccgcggacggctgccctccatcggagaagccaacaagcccctggataacattgcaagcattgtggacgcaccccagaaacggccgagccattctcgcaagtcgtccgcccctcaagataacatggcaaccgggctcgccatgcagcgcgctgctacggccagcccaatgatgatgagggaccagtaccagcgcgccgtgcaagggtacggaggagagcgaccgccgtctcccgaccataacatcatgagcagactgcaagaggtccattcggcacagcgaaacggctcccgtgaccggattcctgctcaccttagcctgcagctgcagacgatgcagccgccatcgatggaggcaatgtctcctgagcaatccggcgcctcatccgctcgcttccactggccgtctcgtcgccgcggtactggtcctagttccgcatctgtggccggttccatgacatccacctccagcgctggccggagtcacaaatcgaacgctcgacaaagggatgattacatccatagcctggaagcggctcagcactattccaggagagctggaagccggaccggaagcaaggaacggacacgagacgcgtccaccggccgccacgccagccgagagcgacgaaccaagtcgcgcgacccttcggacgagcgcggcagggcttcagccagatcctggacaaggccaaagcgatcacccacatccccagttccaatgtcccccgaagacttggccatgctgagcaaccggacattcgacaactccgtggaacccctcacgattcgaaaggcgagcgtggcgaaaggcaaggccagcgggcggacatccagccgcggaaggggtggatcagtaccgcggtcaccgccgtccccggtgccgctgtcggcaacagccctgcattatcagggatcggaggacgaggaggactttagagcagccatgcgggcgcaggaagagttcagggccaagcacagccgcagcgtcggccacaacgtcaattctcccgccgtaagccggcgtgagcattcggaaagccgacgaaaggaagcgactgagactcgagaggctgcacccgtggtcttgagccagacagtatatggacgagccgcttccaccgagcacgccggcgatctgaagaagatgaaggacgagagacagcggaagaaggaacaggctgcgcgagagctagaagagcgtaggaagtctctggccaagcgacagctcggtccccagattccccatccaagccagatctctcccgggagaccgccggttctggtagaggccgacgatgaaaagctgccggatgatctgccgccgcgctctgcaacagaacccccgaggacggcggagccgccgaggagcatgtatgctcaaaacaggccgcagattggcctgcctgccactcccaaggcgatgaggctcattatccggtctgacgagaatcagtacgaggacctccctgctccgccggtgccggcgacgttttctcaaaagtattcgccgcagaactcaccccagtactctccgaaatacacgttgggcagtagtgtttatggagaggagcagaagcagcagcagcagcagcagcaacagcagggacagcagcagcagcaacaacgacagcaacaacaacagcagcagcagcaacagcaacagcagcagcagcaacaacaacaactctttcatcagaaagaggaggagccgccgttgacactgctgccatcgactgtctatcagctgccgtccactgtctaccaaccgccgtctcgccccatgattccgcgaagcatgtcggcaccgatccctgatgagccacctcacgcaattcgatacgggagaaagtcgagtgctaacgagggcagaggcctcgacgatattgtagagacggagtggcgtcgacaagtgaacaacctggtgccgcctccaccaccacctcccccttcggcgcccctgactttcctcaaggagctgcagcatctagccgtgccgccccctcctccgccagcaccgctgccacacgtgcgacgccagccgcccgtggctggaacactggcctcgggcatgatcgaaattgtcatggacgatgacgaggcagaagagcccatgtcggctgctcccaacgacggcatggtgccggtgctcgcccagcccgaaccccctgtcaagggccacaaccgcggtcgcagcctcggggagggcagcctttccgggcgtaggaccaaggcgacggagcgcctccgctcgggcagccgcagccgcaaaggatccatcggcgtcatgtcgccccctctcgagatgtacggcggtgagggcaatgccaactcgctgaaccagctcaggtcgcccgtggtgggcaatcctccgcctgtgctgtatgaccgggacgccattcgatcgcccattgaggggcatggccgcaagatgtcgatggggctgcacgagaacggcatgttttaggcttgggtgggcgacttgttgtgtcgcacaaggagttggggcctattcggtattcgctgtcaggctgttcttcgatgcctgtatacgacgcctgcatacgatgcgtttgtcgccatgactttgcttgctttcattggctctgttcttttccgatcgaggaggtttcttccccccccgtgcctggcatctgtgagcatgggacgatatcttgtgtgtccctttggggcaatatttcttttcaattctgatagttggcatggccattcctttgtcttctcttcgttcggtctttcagttctaaagccctccccccttcctttccacttgaggaaagaagaagctgtcttacttcttatccaagtgtgttttagtgagcatgtgcaaaactgggtgctgggatgctttctcttcatttgctttggcaacgtcattatgtccaggggatggttttttcatggaatggcggcttgcaaataccatgcaagctatgtatatcccggcttgaagactcttttctcgctttccttcactgcatctttttttttctctctctcttcgattctttatgactgacgacgggcacctctttttctttttctttttctgggcggaggtataagagaagcaagtaggtggtatgcggaatctagacggctttgatttcct

SEQ ID NO: 227 - protein, 1505 aa, Artificial sequence
  Synthetic Construct
MPSAADLKYFIPSAATASIFLYAQGPTITAIVWDLMTGDEISRFVSYETLTVAAWMRNGNVAFGNTQGNIIMFEPTTSEHISARTLDQIAVTALAPSSDCRTFAIGGPSPIVTLAWHASSSRQKSDMLAVQTHDGDLRVWSVAKSYSAEDPAKVVRVLRRNENFLAGPNWMGWSKNGRIIQYSDSETFSWDVRTKHVTKDSIPTLEHVKGLAVYGPGASLFTLGPNNTVQQFDLNSPAIMVANVQHPAGVLPPSPPTSEETGGRSVHSATTIHTSESESSSVPLEMGISESDDDHLSPFQRLAKRNAPEARNEVYDTGSAASSQSGVSSLSKSSASSRTPGRQASSLRSRGMTEGTYISAGSSMKTSTVGQREADNYSMGYTLPSTSGPSLASSRSRHRPSRLRHEVPRSPDEANVQDLFKYTRSRLSDLPYKHPMPTQRSHPTNDDLRRQMLSTIFGWNKEVEDLIRDEMSRYPAGSANRILLAKWLGDIDADIMAAGSQNMTSQDWMLLALSGIGGQASQHKLGRVYVQRLLENGDVHVAVTIMLGMGDYNDAIEVYISHKRYMEALILTCVAFPSVWERQAAIVRKWGEWAVKHGQQQLAIRCFACTDQESSEPWTSPSAAQLNFQNITPSIPEVLSPPLSPPGIQRGPQRSVAKASALKLITSFGDPTQKAKFYSQADGGQTPIAAGVTPIAESAISPGGAYDPATAFLRPSGNSRFNTPTSARPIGQGFSRGRLPSIGEANKPLDNIASIVDAPQKRPSHSRKSSAPQDNMATGLAMQRAATASPMMMRDQYQRAVQGYGGERPPSPDHNIMSRLQEVHSAQRNGSRDRIPAHLSLQLQTMQPPSMEAMSPEQSGASSARFHWPSRRRGTGPSSASVAGSMTSTSSAGRSHKSNARQRDDYIHSLEAAQHYSRRAGSRTGSKERTRDASTGRHASRERRTKSRDPSDERGRASARSWTRPKRSPTSPVPMSPEDLAMLSNRTFDNSVEPLTIRKASVAKGKASGRTSSRGRGGSVPRSPPSPVPLSATALHYQGSEDEEDFRAAMRAQEEFRAKHSRSVGHNVNSPAVSRREHSESRRKEATETREAAPVVLSQTVYGRAASTEHAGDLKKMKDERQRKKEQAARELEERRKSLAKRQLGPQIPHPSQISPGRPPVLVEADDEKLPDDLPPRSATEPPRTAEPPRSMYAQNRPQIGLPATPKAMRLIIRSDENQYEDLPAPPVPATFSQKYSPQNSPQYSPKYTLGSSEPPLTLLPSTVYQLPSTVYQPPSRPMIPRSMSAPIPDEPPHAIRYGRKSSANEGRGLDDIVETEWRRQVNNLVPPPPPPPPSAPLTFLKELQHLAVPPPPPPAPLPHVRRQPPVAGTLASGMIEIVMDDDEAEEPMSAAPNDGMVPVLAQPEPPVKGHNRGRSLGEGSLSGRRTKATERLRSGSRSRKGSIGVMSPPLEMYGGEGNANSLNQLRSPVVGNPPPVLYDRDAIRSPIEGHGRKMSMGLHENGMF

SEQ ID NO: 228 - DNA, 3436 bp, Artificial sequence
  functional variant (c.2706T>A; p.Ser441Thr) of corrected mating gene 76887; Aspartyl protease
  CDS (1263)..(1476)
  CDS (1600)..(2723)
taaaacgacggccagtgaattcttctctgatcgttgggctatgaatagtgctgggagcgaatccatcagacatctcactggaatgtttaataccaccagacttggcattgcttttatgcccaatatgaaggctcaaaacttagcagcttgaatcgcttgttaacagacctcatcaaaagatgctccatcagcctttgaaaagttggaggcgggagtcgatccacaaggttcgatgacgacggaggctgtcgaggccttttcccagcgatccgaagactccccacagactccgcatgctctgatgctcagctggctgcttgattgggctgacgctccatgctctccataatctccataccagcaacaagctttttacgcatatcttgaagaatgacagaactttgatactataagcatttataaggtagtagaatagttcttcgtgtaggtaggtagcagtagtactaggcaactctactctgaggcaacctcgtacgtagtagtagtagtgagtagcttgtcgagcctcctccaggccacccgccgcttgatccgcctgaaatagcgtcgcgtagctgatgaaccgagcgccacaaagcggaaagacgagcttggcggctcgaatccaggcggaccggagcaataaagtccagcactagtgggtgtccaagaggagctgcgccgcgttgctccagcttcagctccggccaagctccaaggttcaagaaagttgtcggcaagacgcgactcggaaaggctgtgggcgtctctgctcctatggagcagtgcagccaccaggccagaggggctgcttcaccgataatggctaggggaggaggccagatgaatggaagatgagatcatgaaggaggacgtaaaggctcttcttacaaatagtactacttttaccccggaaaccggacgagctggcaacgtttgctctccttgtcccgtcactttcgacccttgtcgccgtcgtccccgctagcagcaagatcgtgccgagatcttgctctgttgctttggtggtttgccgtgctctgttttcgttgtcgtacgaactcagcctacctacttattctttctcttatcctaatacttcattctgtattactcccgttctcagttcttcatccctttgcttccggtttttgatcaatatactttacagggagaggagaagagaagagaagcggaagggaagtgacaggaagagagagagaggggatagaagaagagtcggcagagctctcagcgcaaccatgaggccgccaacgtcgttgtcagcagctctgacgctgctcctcgcgacggattacattgaagccatcgctactcccgttttcccgagggcgaaatctggggatgggtatttggcgattcccgtgggaaccatcccgaggccgcacaaggtcggcaagagaagcgccatcgatgctacgctacagaacatggactttttctatgccattcaaggtaatgcatcacctttgttaacaccaccagaagcttctgttcagctcgtgtctctatcgtccgcttttaagtgcactatctacggtctgcaaagtgtacatgctaataaatggtcggcaacagtcggcatgggaacgcctccccagaatgtgaccgtcctcgtcgacacgggatccagcgagctatgggtcaatcccgactgctcaaccgcgccgtcccagcaacaggccgacatgtgcgagaatctgggccagtacaaccccaggaaatcaagaacaccgcccgtcggcccgtttgggcgtgaagagatcaactatggcgaccctacggaccagtccacgcagacgtcggtcgacattacctactatgccgacacgctgagctttggcagcatccaggtcaagaaccagacgtttggcgtcgtcacggccagcgacggccaggcgcagggcatcatgggcctcgcacccgacgtccggggcggattcccgggagacgagccgtacagcctgctgctcaacaccatggccgagcagggtgtcattgcaagccgagtctttgcactcgatctccggcactccgactcggagacaggcgccatcatctacggcggcctcgatcgcagcaagtttgtcggctctctcgaagcacgtccgattgtgcgcggcatcaagggcgaaactcggctggccgtcaacctcacgacgctgggcctcaccctgggccggtcccagagcttccggctctctgctgccgacaccaacgtgatgctcgactccggcacgacgctcagccggatgcacgaggctgctgccattcccatcctcgaggccctgggcgcccaagacgccggcgagggctacttctacgtgccgtgctcgacccggaacgctggcggcagtgtagatttcggcttcggcaacaaggttgtccgcgtccccttttccgactttatactgacgggcgaagactcgagcgactcagactattgcttcgttggcatcgtcatcaccaccgaccagcagattctgggcgacacggtgctgcgggccggatactttgtctttgactgggacaaccgggaggttcacattgcccaggccgcggattgcggcagcagtgacattgttgttgctggcagggggtccgatgccgttcccagcgttcaggggaactgcaatgagaacgaagcgtttcccaccggctcaggaagcccaacggtaagcatcacttttgtccaaactgcgtgacaaccgacgactaaccacaagtctcgctgcagatcactgcatccaactccggagccaccaacttgatcccgacctcggccttcacgacgacgtttacggtgacgtcctgcccggtcttcgacatcaactgccgcaccggcgtcgtcacgacgcggacggttcggccagctgaagccactgccgaacctacaagcaccagctctcccagcggctccggcagcggcgacggggatggcggaggtgatgaagacgctggtgtacggcttgtcccttttacctgggtgctcgtggcgctgggcaccctggcaatgtttgtcaacattgtataaattgtccaggaggtcatttctcttggataggtactcagagcttgtttacacgtttcgaagcttttgtatatacgggtgagctggatcggccgacattaatgggcattcgcgattaggtagaggatttatcctaggatcttgaatatgaggcaggggatttgaatagacggacgatgcattgtctttggttttctgcaaaaggcaccagcctggtcaacgcgtaatacccatgacattgatgattgtaggtagtatgtcatgtagaaacgggtctttgtgaagtggaagtatcagtaagccgtatagttggccttttctgtctcacggggtgactgcatgcacctttgtcttgtcgaggcatctagacggctttgatttcct

SEQ ID NO: 229 - protein, 446 aa, Artificial sequence
  Synthetic Construct
MRPPTSLSAALTLLLATDYIEAIATPVFPRAKSGDGYLAIPVGTIPRPHKVGKRSAIDATLQNMDFFYAIQVGMGTPPQNVTVLVDTGSSELWVNPDCSTAPSQQQADMCENLGQYNPRKSRTPPVGPFGREEINYGDPTDQSTQTSVDITYYADTLSFGSIQVKNQTFGVVTASDGQAQGIMGLAPDVRGGFPGDEPYSLLLNTMAEQGVIASRVFALDLRHSDSETGAIIYGGLDRSKFVGSLEARPIVRGIKGETRLAVNLTTLGLTLGRSQSFRLSAADTNVMLDSGTTLSRMHEAAAIPILEALGAQDAGEGYFYVPCSTRNAGGSVDFGFGNKVVRVPFSDFILTGEDSSDSDYCFVGIVITTDQQILGDTVLRAGYFVFDWDNREVHIAQAADCGSSDIVVAGRGSDAVPSVQGNCNENEAFPTGSGSPTVSITFVQTA

SEQ ID NO: 230 - DNA, 3848 bp, Artificial sequence
  functional variant (c.1308T>A; p.Ser51Thr) of corrected mating gene 59270; Ankyrin repeat protein
  CDS (990)..(1035)
  CDS (1204)..(3104)
taaaacgacggccagtgaattccgccaggttgatcttgttctacagaggccagcgactcagcataattgcttgttcgagcggattagacagatcagtgcagccctcgtcaggcacaaggcacgagtcgaagatatgccccaacccgcagctccagcgcccgtacccaagtcttgttgcctttgtgccacattctgtacccagctgcctaagacgtagcattggacatgtgatgcagatgtatttgtagggggtatcgggaagtgcccgtgtgcttcgcgatgagattccgcagatttacaccctgaaccgctaccctacaataccttacatcttacaagtctacaagggtaaaatacgtcggcatgtgcgagtaccaaaccacaatatgccaacttccgctatctactcacctttgatatattccccacgtacaattattctgccttttcgttgggttaccgctactggtcctcggctgatacatgaaggcggattatcatcctggtgttgtggatcagctgcaatcgaatgggctctacgcaatcatatgaggaaacatcagcataaacaataatatgctaaacgtcagattagagaaaagcaatgagtagaatgacaacctgacgagagttcacgttgtgaacaagcctcgaggctgttcaaggctcggacccaacagggaatacttactactaggtatggagatcaagcctcgtaaagccgggttatgactctgttcagcaccttatcttagtggggtggtcgccggttgactcaacatcattccagcctcgtcatagaggggcaactcttcagccttttctaccaccgcaactcccctcttgctcgcgacaaataccttggtcgcacagctctttgctgttcacgcgtctttcttttgcttcgacagtttaaatacagaagccgccttgcttgccgtaggattcaacgacgctccatacccgcagcctccccgggacttgacacaatggctcagaacccggcagacgagctccttcggcgtccgttatatggtaagtaaaagcactttgtcgcgccactggcaaggcctaccaataccggccgagacacgggacacgagacatacagcttataggacacgcgctgtttcttgcccgagtctcgattcgattctacgatctctgaacaagtgctgacaacttgcgccaacgcggtcttagtctacgatcttccaccagaaagcctcgcaggcttgacgctgaaaccggacgcagacgccatcgccatcgaggaacccgagacgtcaacgactcccagccaggctacggactcgtcctccgacagctttgtcggttcccaagcatgctctctctgcaagctttccttcaccaccgtaatagaccagcgaagtcacatcaagtccgatttccacaactacaatctcaagcagaagctgcggggtcagggcccggtctcagagaccgagttcgaaaagctgattgagactctggacgaatcgctctcgggctccgactcggaagattcggaagacgacgaggacgaagggcgtcaggattctacgcttacggcgctgcttaagaagcaagcaaagctgacggagagacgaaacgccaccagagagaataacaaacaaggcgataatgacgacgatgaactctcaggaaggccaggcaaggggaagccggcgctgatatggttcagctcgccgttgcttccagaaaacacgtatttcggcatctaccgagcgatatttacagatgaagagcaacgccagcccgacttggtcgaggtcatccggaagaagcagctcgagcccatagccatgcctaagcctgcaaaagacgggacgctgccgccgatcgcgtacaaggggccgcacttcttcctctgcatgatcggaggcggccattttgccgccatggtcgtctccctcgcgccgagagccgccaaatcgggcagcacaaccatgaaccgagaggccacggtcctcgcccacaagacctttcacagatacacgacgcgtcgaaaacagggtggttctcagtcggcgaacgacaacgccaaaggcaaagcgcactctgtcggctcgtctctgcgtcggtacaacgaaaccgccctggtcgaggatgtgcgcgctcttctccaggactggaaggggctcttggactcttccgaactgcttttcatcagggcaacaggaacgacaaataggagaaccctgttcggcccctatgaaggacaagttcttcaagccaacgacgctcgtatccgagggtttccatttagtaccaggagagctactcagaacgagctgatgcggtccttcatcgagctaactcgactcaaagtcagggagattgctccaagcaaggcaggactagacaaggcgaacgcggcaccaagcaaacctgcgacaccatccaagccggcaaagccgacgttgtcagaagaggaggaaacggcgctgcttcatacgtctcagctacaagcctttgtacggcggtccaagctacctgcacttttatcgtacctcacaaaaaataacctggatccggactttgagttctatcctccggaacaaaactaccatacaccacgccttttacactacgcagctgctcagaactctgctcctttggtgctggggatccttacacgagccggggcgaacccgttgctcaagaacgcggagggaaagacgcccttcgagctcgctggagatcgctctacgcgggatgcctttagagtagcccgctctgaagtaggagaggggaaatgggactgggatgcggccaaggttcctcccgccatgaccaaggacgaggcagatcgccgtgacgagcgggaaaagcaagaagcagataagaaggagtccgacaggagaaaagcggaagaagagaggctccgtactgaagggccaaggctccctgagcagaagacgaagaagggaaacagcatagcgtccataatcgccaagacgccacaagagcgcagggaggaggaagccagggggctgacgcccgagatgaagttgaaactggaacgagaaagacgagcgcgagcggcagaagagagaatcaagaggctacagggtggtagttgaatatatgcttcctgtgagacagctaagccacgtagtagacgtaggtaggtaggtaggtagctcatgctggcatcaatatcgatctatctgaccttgaaatcacctttggctaggttgccagccgttcacttatgattcctaggacgaaatacccatcaagcaactgaacaacacagcagttgtatctattcagaacctttcttgccgtagcaccacacgtgaaatgctcagcgcgtgtcctcgactggcctacaacagaggaggcactcccaagatatgcgtacatagtccacgtctagcccgagttgaaatcaaacatatgccatacaggccttcgtgcatcttttggatgaacaccaacagcatcaccatcatgcacaacgccctggtagggcataaaagggggggaatatgcccaagtgctctttcttcttcttgaatgcgaaagttcttcacgagaacacggaagtctcatccagcacgcggatgcaccaagcatcttcgcttaagacgctcccatgaacgggtggcagtcacgacgggcaagtggtccgatgccgaagagtggcagctgcaagagcgcctgaaccactgccgagggtttccactcccacactcccacactcccacaaattgctctcctggaaacgacatgttctcccacaaacatttcttccttcacgatacccaacatttctctcattccagcctacacttcgatctagacggctttgatttcct

SEQ ID NO: 231 - protein, 649 aa, Artificial sequence
  Synthetic Construct
MAQNPADELLRRPLYVYDLPPESLAGLTLKPDADAIAIEEPETSTTPSQATDSSSDSFVGSQACSLCKLSFTTVIDQRSHIKSDFHNYNLKQKLRGQGPVSETEFEKLIETLDESLSGSDSEDSEDDEDEGRQDSTLTALLKKQAKLTERRNATRENNKQGDNDDDELSGRPGKGKPALIWFSSPLLPENTYFGIYRAIFTDEEQRQPDLVEVIRKKQLEPIAMPKPAKDGTLPPIAYKGPHFFLCMIGGGHFAAMVVSLAPRAAKSGSTTMNREATVLAHKTFHRYTTRRKQGGSQSANDNAKGKAHSVGSSLRRYNETALVEDVRALLQDWKGLLDSSELLFIRATGTTNRRTLFGPYEGQVLQANDARIRGFPFSTRRATQNELMRSFIELTRLKVREIAPSKAGLDKANAAPSKPATPSKPAKPTLSEEEETALLHTSQLQAFVRRSKLPALLSYLTKNNLDPDFEFYPPEQNYHTPRLLHYAAAQNSAPLVLGILTRAGANPLLKNAEGKTPFELAGDRSTRDAFRVARSEVGEGKWDWDAAKVPPAMTKDEADRRDEREKQEADKKESDRRKAEEERLRTEGPRLPEQKTKKGNSIASIIAKTPQERREEEARGLTPEMKLKLERERRARAAEERIKRLQGGS

The invention claimed is:

1. A process for correcting the mating impairment of a *Trichoderma reesei* QM6a strain or a strain derived thereof having a MAT1-1 locus and that is not competent to mate with a *Trichoderma reesei* QM6a strain having a MAT1-2 locus or a strain derived thereof, wherein a mutated gene or genetic element SEQ ID NO: 134 is replaced by or complemented by inserting a corresponding functional gene(s) and/or genetic element(s) or by transforming strain QM6a (MAT 1-1) with plasmids containing a functional variant(s) of the corresponding functional gene(s) and/or genetic element(s).

2. The process of claim 1, wherein the corresponding functional gene(s) and/or genetic element(s) is/are SEQ ID NO: 216 or SEQ ID NO: 226 or a functionally equivalent sequence thereof.

3. A fungal self-mating competent strain of *Trichoderma reesei* QM6a or a strain derived thereof obtained by a process of claim 1.

4. A fungal strain of the genus *Trichoderma* (*Hypocrea*) suitable for use in the industrial production of a product of interest, whereby the strain has been obtained by a process according to claim 1 and has been transformed with a gene encoding a product of interest.

5. The strain of claim 4, wherein the product of interest is selected from food enzymes, feed enzymes, technical enzymes, hormones, immunoglobulins, vaccines, antibacterial proteins or antiviral proteins.

6. Genes/genetic elements associated with mating impairment in strains of *Trichoderma reesei* QM6a or strains derived thereof having a sequence of SEQ ID NO: 134 or a functionally equivalent sequence thereof.

7. Gene or genetic element essential for mating competence in *Trichoderma reesei* QM6a or strains derived therefrom having a sequence of SEQ ID NO: 216 or SEQ ID NO: 226 or a functionally equivalent sequence derived therefrom.

8. The process of claim 1, wherein the strain derived from *Trichoderma reesei* QM6a is selected from the group consisting of QM9123, QM9136, QM9414, MG4, MG5, RUT-C30, RUT-D4, RUT-M7, RUT-NG14, MCG77, MCG80, M5, M6, MHC15, MHC22, Kyowa X-31, Kyowa PC-1-4, Kyowa PC-3-7, TU-6 and derivatives thereof.

9. The process of claim 1, wherein the corresponding functional gene or genetic element comprises SEQ ID NO: 216 or a functionally equivalent sequence thereof.

* * * * *